US007994114B2

(12) United States Patent
Merzouk et al.

(10) Patent No.: US 7,994,114 B2
(45) Date of Patent: Aug. 9, 2011

(54) CHEMOKINE MIMETICS SYNTHESIS AND THEIR USE

(75) Inventors: Ahmed Merzouk, Richmond (CA); Abdelkrim Habi, Dollard-Des-Ormeaux (CA); Donald Wong, Vancouver (CA); Hassan Salari, Delta (CA)

(73) Assignee: British Canadian Biosciences Corp, Vancouver, BC (CA)

( * ) Notice: Subject to any disclaimer, the term of this patent is extended or adjusted under 35 U.S.C. 154(b) by 858 days.

(21) Appl. No.: 11/393,769

(22) Filed: Mar. 29, 2006

(65) Prior Publication Data
US 2006/0252687 A1 Nov. 9, 2006
US 2007/0275892 A9 Nov. 29, 2007

Related U.S. Application Data

(60) Division of application No. 10/222,703, filed on Aug. 16, 2002, now abandoned, which is a continuation-in-part of application No. 10/086,177, filed on Feb. 26, 2002, now Pat. No. 7,378,098, which is a continuation-in-part of application No. 09/835,107, filed on Apr. 12, 2001, now abandoned.

(60) Provisional application No. 60/373,629, filed on Apr. 17, 2002, provisional application No. 60/373,628, filed on Apr. 17, 2002, provisional application No. 60/232,425, filed on Sep. 14, 2000.

(51) Int. Cl.
A61K 38/00 (2006.01)
A61K 31/70 (2006.01)
A61K 45/00 (2006.01)
A61K 48/00 (2006.01)
C07K 14/00 (2006.01)
C12Q 1/00 (2006.01)
G01N 63/00 (2006.01)
C12N 15/63 (2006.01)
C12N 5/08 (2006.01)
A01N 63/00 (2006.01)

(52) U.S. Cl. ........ 514/1.1; 424/85.2; 424/9.1; 424/85.1; 424/93.7; 435/4; 435/7.1; 435/7.93; 435/325; 435/355; 435/372; 435/455; 530/300; 530/351; 514/44

(58) Field of Classification Search .................. None
See application file for complete search history.

(56) References Cited

U.S. PATENT DOCUMENTS

| | | |
|---|---|---|
| 2,530,369 A | 11/1950 | Simons |
| 2,760,992 A | 8/1956 | Schoeffel et al. |
| 4,554,101 A | 11/1985 | Hopp |
| 4,868,116 A | 9/1989 | Morgan et al. |
| 4,980,286 A | 12/1990 | Morgan et al. |
| 5,082,670 A | 1/1992 | Gage et al. |
| 5,166,320 A | 11/1992 | Wu et al. |
| 5,399,346 A | 3/1995 | Anderson et al. |
| 5,401,651 A | 3/1995 | Walz |
| 5,563,048 A | 10/1996 | Honjo et al. |
| 5,756,084 A | 5/1998 | Honjo et al. |
| 5,807,744 A | 9/1998 | Berneman et al. |
| 5,856,301 A | 1/1999 | Craig et al. |
| 5,871,723 A | 2/1999 | Strieter et al. |
| 5,919,776 A | 7/1999 | Hagmann et al. |
| 5,962,462 A | 10/1999 | Mills et al. |
| 5,990,163 A | 11/1999 | Evans et al. |
| 6,013,644 A | 1/2000 | Mills et al. |
| 6,022,848 A | 2/2000 | Kozlov et al. |
| 6,046,185 A | 4/2000 | Burgoyne et al. |
| 6,124,319 A | 9/2000 | MacCoss et al. |
| 6,132,987 A | 10/2000 | Charo et al. |
| 6,133,319 A | 10/2000 | Widdowson |
| 6,136,827 A | 10/2000 | Caldwell et al. |
| 6,140,349 A | 10/2000 | Caldwell et al. |
| 6,166,037 A | 12/2000 | Budhu et al. |
| 6,204,294 B1 | 3/2001 | Bryan et al. |
| 6,356,887 B1 | 3/2002 | Berenson et al. |
| 6,515,001 B2 | 2/2003 | Saxena et al. |
| 6,613,742 B1 * | 9/2003 | Huang et al. ............ 514/12 |
| 6,676,937 B1 * | 1/2004 | Isner et al. ............ 424/93.7 |
| 6,693,134 B2 | 2/2004 | Saxena et al. |
| 2002/0156034 A1 | 10/2002 | Tudan et al. |
| 2002/0165123 A1 | 11/2002 | Tudan et al. |
| 2003/0004136 A1 | 1/2003 | Saxena et al. |
| 2003/0045550 A1 | 3/2003 | Saxena et al. |
| 2003/0092674 A1 | 5/2003 | Saxena et al. |

(Continued)

FOREIGN PATENT DOCUMENTS

WO    WO 89/02468    3/1989

(Continued)

OTHER PUBLICATIONS

U.S. Appl. No. 10/243,795, filed Sep. 13, 2002, Merzouk, et al.
U.S. Appl. No. 10/932,208, filed Aug. 31, 2004, Merzouk, et al.
Acsadi, G., et al., *Nature* 352:815-818, (1991).
Aiuti, A., et al., *J. Exp. Med.* 185(1):111-120, (1997).
Aiuti, A., et al., *Eur. J. Immunol.* 29:1823-1831, (1999).
Alkhatib, G. et al., *Science* 272:1955-1958, (1996).
Allen, M. et al., *J. Biomolecular Screening* 5(2):63-69, (2000).
Alleva, D., et al., *J. Immunol.* 161(12):6878-6884, (1998).
Anderlini, P., et al., *Blood* 90(3), 903-908, (1997).
Anderson, W., et al., *Science* 288:627-629, (2000).
Arenzana-Selsdedos, F., et al., *Nature* 383:400, (1996).

(Continued)

*Primary Examiner* — Maury Audet
(74) *Attorney, Agent, or Firm* — Syndicated Law; Brian S. Boyer

(57) ABSTRACT

The present disclosure generally teaches compositions comprising SDF-1 mimetics and methods of using them to modulate an activity of a cell having an SDF-1 receptor by binding the SDF-1 receptor to an SDF-1 mimetic. The cell can be a hematopoietic cell, for example, and can be selected from a group consisting of hematopoietic stem cells, hematopoietic progenitor cells, primitive granulocytes, primitive erythroid cells, leukocytes, and neutrophils. In some embodiments, the activity can include the rate of multiplication of the cell or, where the cell is a quiescent cell, the binding can repress the activation of the quiescent cell. Other embodiments of the present invention are taught herein.

22 Claims, 30 Drawing Sheets

U.S. PATENT DOCUMENTS

| | | |
|---|---|---|
| 2003/0125380 A1 | 7/2003 | Saxena et al. |
| 2003/0148940 A1 | 8/2003 | Tudan et al. |

FOREIGN PATENT DOCUMENTS

| | | |
|---|---|---|
| WO | WO 89/05345 | 6/1989 |
| WO | WO 89/07136 | 8/1989 |
| WO | WO 90/06757 | 6/1990 |
| WO | WO91/04274 | 4/1991 |
| WO | WO 92/07573 | 5/1992 |
| WO | WO 93/10234 | 5/1993 |
| WO | WO93/13206 | 7/1993 |
| WO | WO 95/05452 | 2/1995 |
| WO | WO 95/09236 | 4/1995 |
| WO | WO 96/40772 | 12/1996 |
| WO | WO 97/28257 | 8/1997 |
| WO | WO 97/28258 | 8/1997 |
| WO | WO 98/04684 | 2/1998 |
| WO | WO 98/04698 | 2/1998 |
| WO | WO 98/09642 | 3/1998 |
| WO | WO 98/51705 | 11/1998 |
| WO | WO 99/47158 | 9/1999 |
| WO | WO 0009152 | 2/2000 |
| WO | WO 01/76615 | 10/2001 |
| WO | WO 01/85196 | 11/2001 |
| WO | WO2004/024088 A2 | 3/2004 |

OTHER PUBLICATIONS

Armentano, D., et al., *Proc. Nat'l. Acad. Sci. 87*:6141-6145, (1990).
Ausubel, et al., *Current Protocols in Mol. Biol. Supp. 36*:9.10.1-9.14.6, (1995).
Avenarius, H., et al., *Inter. J. Hematology 58*:189-196, (1993).
Baggiolini, M., *Nature 392*:565-568, (1998).
Baird, A., et al., *Current Opinion in Immunology 11*:157-166, (1999).
Balasa, B., et al., *J. Exp. Med. 186*:385-391, (1997).
Baldari, et al., *The EMBO J. 6*(1):229-234, (1987).
Barbier, J., et al., *J. Med. Chem. 40*(9):1373-1380, (1997).
Barbier, J., et al., *Biochemistry 39*(47)14522-14530, (2000).
Barnerji, et al., *Cell 33*:729-740, (1983).
Barnes, D., et al., *J. Clin. Invest. 101*(12):2910-2919, (1998).
Batory, D., et al., *ACM transactions on Software Engineering and Methodology 1*(4):355-398, (1992).
Belperio, et al., *J. Leukoc. Biol. 68*:1-8, (2000).
Benoist, et al., *Nature 290*:304-310, (1981).
Berkner, K., *Biotechinques 6*(7):616-628, (1988).
van Beuschem, V., et al., *Proc. Nat'l. Acad. Sci 89*:7640-7644, (1992).
Blease, K., et al., *J. Immunol. 165*:1564-1572, (2000).
Bleul, C., et al., *J. Exp. Med. 184*:1101-1109, (1996).
Bleul, C., et al., *Nature 382*:829-832, (1996).
Bollon, et al., *J. of Clinical Hemotology and Oncology 10*:39-48, (1980).
Bork, et al., *Trends in Genetics 12*(10):425-427, (1996).
Bork, A., *Genome Res. 10*:398-400, (2000).
Botstein, et al., "Making Mutations in Vitro and Putting them Back Into Yeast", Dept of Biol. Massachussetts Institute of Technology, 265-274, (1982).
Brandt, J., et al., *J. Clin Invest. 86*:932-941, (1990).
Brandt, J., et al., *Blood 79*(3):634-641, (1992).
Brandt, J., et al., *J. Clin. Invest. 82*:1017-1027, (1998).
Brenner, S.E., *Trends in Genetics 15*(4):132-133, (1999).
Broach, J.R., *The Molecular Biology of the Yeast Saccharomyces*, 445-470, (1981).
Broach, J.R., *Cell 28*:203-204, (1982).
Buckley, C., et al., *J. Immunol. 165*:3423-3429, (2000).
Burt, R., *Stem Cells 17*(6):366-372, (1999).
Buser, et al., *Methods in Molecular Biology 138*:143-148, (2000).
Calame, et al., *Advances in Immunology 43*:236-275, (1988).
Campbell, J., et al., *Science 279*:381-383, (1998).
Camper, et al., *Genes & Development 3*, 537-546, (1999).
Carr, M., et al., *Proc. Nat'l. Acad. Sci. 91*:3652-3656, (1994).
Cashman, J., et al., *Blood 94*(11):3722-3729, (1999).
Cavazzana-Calvo, M., et al., *Science 288*:669-672, (2000).
Cenatiempo, Y., *Biochimie 68*:505-515, (1986).
Charo, I., et al., *Proc. Natl. Acad. Sci. 91*:2752-2756, (1994).
Choe, H., et al., *Cell 85*:1135-1148, (1996).
Chowdury, J., et al., *Science 254*:1802-1805, (1991).
Clapp, W., et al., *Blood 78*(4):1132-1139, (1991).
Clark-Lewis, I., et al., *J. Biol. Chem. 269*(23):16075-16081, (1994).
Cocchi, F., et al., *Science 270*:1811-1815, (1995).
Colosimo, et al., *BioTechniques 29*:314-331, (2000).
Combadiere, C., et al., *J. Biol. Chem. 270*:16491-16494, (1995).
Conti, J., et al., *Cancer 70*(11):2699-2702, (1992).
Cristiano, R., et al., *Proc. Nat'l. Acad. Sci. 90*:2122-2126, (1993).
Crump, M., et al., *EMBO Journal 16*(23):6996-7007, (1997).
Curiel, D., et al., *Proc. Nat'l. Acad. Sci. 88*:8850-8854, (1991).
Cushing, S., et al., *Proc. Nat'l. Acad. Sci. 87*:5134-5138, (1990).
Cwirla, S., et al., *Science 276*:1696-1699, (1997).
Dai, Y., et al., *Proc. Nat'l. Acad. Sci. 89*:10892-10895, (1992).
Danos, O., et al., *Proc, Nat'l. Acad. Sci. 85*:6460-6464, (1988).
Daugherty, et al., *Chemokine Protocols 138*:129-148, (2000).
Daugherty, et al., *Methods in Molecular Biology 138*:129-134, (2000).
Demirer, T., et al., *Stem Cells 14*:106-116, (1996).
DeNardo, et al., *Cancer 94*:1275-1286, (2002).
Deng, H., et al., *Nature 381*:661-666, (1996).
Dhib-Jalbut, S., et al., *Journal of Interferon and Cytokine Research 16*:195-200, (1996).
Di Salvo, J., et al., *Eur. J. Pharm. 409*:143-154, (2000).
Doerks, et al., *Trends in Genetics 14*(6):248-250, (1998).
Doranz, B., et al., *Cell 85*:1149-1158, (1996).
Dragic, T., et al., *Nature 381*:667-673, (1996).
Dufour, J.H., et al., *The Journal of Immunology 167*(7077-7083):3195-3204, (2001).
Dunican, A., et al., *Shock 13*(3):244-250, (2000).
Durig, J., et al., *Leukemia 14*:1652-1660, (2000).
Edlund, et al., *Science 28*:912-916, (1985).
Eglitis, M., et al., *Science 320*:1395-1398, (1985).
Elisseeva, E., et al., *J. Biol. Chem. 275*(35):26799-26805, (2000).
Elseviers, M. et al., *Biochem. and Biophys. Research Comm. 154*(2)515-521, (1988).
"Expression in E. coli", Methods in Enzymology, 185:119-129, (1990).
Federsppiel, B., et al., *Genomics 16*:707-712, (1993).
Feng, Y., et al., *Science 272*:872-877, (1996).
Ferry, N. et al., *Proc. Nat'l. Acad. Sci.*, 88:8377-8381, (1991).
Fletcher, F., et al., *Blood 76*(6):1098-1103, (1990).
Flotte, T., et al., *Am. J. Respir. Cell Mol. Biol. 7*:349-356, (1992).
Flotte, T., et al., *J. Biol. Chem. 268*(5):3781-3790, (1993).
Francis, et al., *International Journal of Hematology 68*:1-18, (1998).
Furuichi, K., et al., *Am. J. Nephrol. 20*:291-299, (2000).
Gazitt, *J. Hematother. Stem Cell. Res. 10*:229-236, (2001).
Gimbrone, M., et al., *Science 246*:1601-1603, (1989).
Girait, S., et al., *Blood 89*(12):4531-4536, (1997).
Glick, et al., *J. of Industrial Microbiology 1*:277-282, (1987).
Glimm, et al., *Blood 99*(9):3454-3457, (2002).
Goetz, G., *ACM Computing Surveys 25*(2):73-170, (1993).
Gold, et al., *Ann Rev. Microbiol. 35*:365-403, (1981).
Gong, J. et al., *J. Biol. Chem. 271*(18):10521-10527, (1996).
Gottesman, S., *Ann. Rev. Genet. 18*:415-441, (1984).
Gupta, S. et al., *J. Biol. Chem. 273*(7):4232-4287, (1998).
Haas, R. et al., *Bone Marrow Transplantation, 9*:459-465, (1992).
Hamada, T., et al., *J. Exp. Med. 188*(3):539-548, (1998).
Hamer, et al., *J. of Molecular and Applied Genetics 1*:273-288, (1982).
Hartung, H. et al., *Ann. Neurol. S57*:S57-S63, (1990).
Hattori, et al., *Blood 97*:3354-3359, (2001).
Hébert, et al., *The J. of Biological Chemistry 266*(28):18989-18994, (1991).
Hermonat, P. et al., *Proc. Nat'l. Acad. Sci. 81*:6466-6470, (1984).
Herz, J., et al., *Proc. Nat'l. Acad. Sci. 90*:2812-2816, (1993).
Heveker, N., et al., *Current Biology*, 8:369-376, (1998).
Hindmarsh, J., et al., "Fragmented Interaction: Establishing Mutual Orientation in Virtual Environments," Proceedings of the 1998 ACM Conference on Computer Supported Cooperative Work, 217-226, (1998).
Ho, A., et al., *Leukemia*, 7(11):1738-1746, (1993).

Hodohara, K., et al., *Blood* 95(3):769-775, (2000).
Holmes, W., et al., *Science* 253(50):1278-1280, (1991).
Hooper, D., et al., *Proc. Nat'l. Acad. Sci.* 95:675-680, (1998).
Horuk, R., et al., *J. Biol. Chem.* 276(6):4199-4204, (2001).
Huang, S., et al., *Nature* 360:745-749, (1992).
Huber, A., et al., *Science* 254:99-102, (1991).
Huber, B., et al., *Proc. Nat'l. Acad. Sci.* 88:8039-8043, (1991).
Hwu, P., et al., *J. Immunol.* 150:4104-4115, (1993).
IFNB Multiple Sclerosis Study Group, *Neurology* 43:655-661, (1993).
Ikebuchi, K., et al., *Nat. Acad. Sci.* 85(10):3445-3449, (2001).
Imai, T., et al., *J. Biol. Chem.* 272(23):15036-15042, (1997).
Imai, T., et al., *J. Biol. Chem.* 273(3):1765-1768, (1998).
John Jr., et al., *Reviews of Infectious Diseases* 8(5):693-704, (1986).
Johnston, et al., *Proc. Natl. Acad. Sci. USA* 79:6971-6975, (1982).
Jones, S., et al., *J. Biol. Chem.* 272(26):16166-16169, (1997).
Kaltsas, et al., *Ann. Oncol.* 12(Supp. 2)S47-50, (2001).
Kates, S., et al., *Analytical Biochemistry*, 212:303-310, (1993).
Kaufman, et al., *The EMBO J.* 6(1):187-193, (1987).
Kawachi, Y., et. al., *Brit. J. Hematology*, 94:413-416, (1996).
Kay, M., et al., *Human Gene Therapy* 3:647-647, (1992).
Kessel, et al., *Science* 249:374-379, (1990).
Kessinger, et al., *Bone Marrow Transplantation* 4:643-646, (1989).
Kieseier, et al., *Brain* 125:823-824, (2002).
Kim, C., et al., *J. Leukocyte Biology* 65:6-15, (1999).
Kitaura, M. et al., *J. Biol. Chem.* 271(13)7725-7730, (1996).
Koch, et al., *Science* 258:1798-1801, (1992).
Kowalska, M., et al., *Blood* 96(1):50-57, (2000).
Kramer, W., et al., *J. Biol. Chem.* 267(26)18598-18604, (1992).
Kume, A., et al., *Int. J. Hematology* 69:227-233, (1999).
Kurjan, J., et al., *Cell* 30:933-943, (1982).
Kuroiwa, M., et al., *Int. J. Hematology* 63:311-316, (1996).
Lane, et al., *Blood* 96:4152-4159, (2000).
Lasky, L., et al., *Transfusion* 21(3):247-260, (1981).
Lataillade, J., et al., *Blood* 95(3):756-768, (2000).
Law, P., *Exp. Hematol.* 11(5):351-357, (1983).
Le Chevalier, T., *Eur. J. Cancer* 30A(3):410-412, (1994).
Leary, A., et al., *Blood* 71(6):1759-1763, (1988).
Lejeune, et al., *Cancer Immunol. Immunother.* 38:167-170, (1994).
Lemarchand, P., et al., *Nat. Acad. Sci.* 89(4):6482-6486, (1992).
Li, et al., *J. Biol. Chem.* 273(26):16442-16445, (1998).
Lin, T., et al., *J. Immunol.* 165:211-220, (2000).
Loetscher, M., et al., *J. Biol. Chem.* 269(1):232-237, (1994).
Loetscher, P. et al., *FASEB J.* 8:1055-1060, (1994).
Loetscher, P., et al., *J. Biol. Chem.* 273(35):22279-22283, (1998).
Lohrmann, H., et al., *B. J. Haematol.* 40:369-381, (1978).
Lombart, H., et al., *J. Org. Chem.* 59:6147-6149, (1994).
Luckow, et al., *Virology* 170:31-39, (1989).
Lukacs, N., et al., *J. Immunol.* 158:4398-4404, (1997).
Luo, J., et al., *Biochemical and Biophysical Research Communications* 264:42-47, (1999).
Mach, et al., *Curr. Opin. Immunol.* 12:571-575, (2000).
Maged, M.M., *Proceedings of the Fourteenth Annual ACM Symposium on Parallel Algorithms and Architectures* 73-82, (2002).
Maged, M.M., *Proceedings of the Twenty-First Annual Symposium on Principles of Distributed Computing* 21-30, (2002).
Maniatis, *Cell Biology* 3:564-608, (1980).
Marshall, G. et al., *Tetrahedron* 49(17):3547-3558, (1993).
McKnight, S.L., *Cell* 31:355-365, (1982).
McLaughlin, S., et al., *J. Virology* 62(6):1963-1973, (1988).
Miller, et al., "An Insect Baculovirus Host-Vector System for High-Level Expression of Foreign Genes," 277-297, (1986).
Miller, et al., *J. Immunol.* 143(9):2907-2916, (1989).
Miller, D., *Blood* 76(2):271-278, (1990).
*Molecular Cloning a Laboratory Manual*, Third Ed., vol. 1, (2001).
Moss, T., et al., *Blood* 76(9):1879-1883, (1990).
Moss, J., *American Chem. Soc.* 18:423-448, (1995).
Murphy, P., et al., *Science* 258:1280-1283, (1991).
Muzyczka, N., *Current Topics in Microbiol. and Immunol.* 158:98-129, (1992).
Myers, S., et al., *J. Biol. Chem.* 270(11):5786-5792, (1995).
Nagai, U., et al., *Tetrahedron* 49(17):3577-3592, (1993).
Nagasawa, T., et al., *Proc. Nat'l. Acad Sci.* 91:2305-2309, (1994).
Nagasawa, T., et al., *Proc. Nat'l. Acad. Sci.* 93:14726-14729, (1996).
Nagasawa, T., et al., *Nature* 382:635-638, (1996).
Nagasawa, *Int. J. Hematol.* 72:408-411, (2000).
Neote, K., et al., *Cell* 72:415-425, (1993).
Ng, H., et al., *J. Med. Chem.* 42:4680-4694, (1999).
Ngo, et al., *The Protein Folding Problem and Tertiary Structure Prediction*, 492-495, (1994).
Nomura, et al., *Int. J. Cancer* 91:597-606, (2001).
Oberlin, E., et al., *Nature*, 382:833-835, (1996).
Peled, A., et al., *Science* 283:845-848, (1999).
Pettengell, R., et al., *Blood* 82(7):2239-2248, (1993).
Perez, et al., *Exp. Hematol.* 32:300-307, (2004).
Pinkert, et al., *Genes & Development* 1:268-276, (1987).
Ponath, et al., *Methods in Molecular Biology* 138:113-120, (2000).
Quantin, B., et al., *Proc. Nat'l. Acad. Sci.* 89:2581-2584, (1992).
Queen, et al., *Cell* 33:741-748, (1983).
Ramduny, D., et al., *Proceeding os the 1998 ACM Confernece on Computer Supported Cooperative Work* 227-238, (1998).
Richman, C., et al., *Blood* 47(6):1031-1039, (1976).
Richmond, A., et al., *J. Cell Phys.* 129:375-384, (1986).
Ripka, W., et al., *Tetrahedron*, 49(17):3593-3608, (1993).
Rosenfeld, M., et al., *Science* 252:431-434, (1991).
Rosenfeld, M., et al., *Cell* 68:143-155, (1992).
Rubin, G.M., *Science* 240:1453-1459, (1988).
Rudick, R., et al., *Neurology* 50(5):1294-1300, (1998).
Sabers, A., et al., *Acta. Neurol. Scand.* 92:19-27, (1995).
Sambrook, J., et al., *Cold Spring Harbor Laboratory Press*, (1989).
Samulski, R., et al., *J. Virology* 63(9):3822-3828, (1989).
Seed, B., *Nature* 329(29):840-842, (1987).
Schiffer, C., et al., *Ann. N.Y. Acad. Sci.* 161-169, (1983).
Schulz, L., et al., *Gene* 54:113-123, (1987).
Schwarting, A., et al., *J. lmmunol.* 161:494-503, (1998).
Schwarz, et al., *Nat. Rev. Drug Discov.* 1:347-358, (2002).
Shimoda, K., et al., *J. Clin. Invest.* 91(4):1310-1313, (1993).
Shirozu, M., et al., *Genomics* 28:495-500, (1995).
Siena, S., et al., *Blood* 74(6):1905-1914, (1989).
Silver, et al., *Proc. Natl. Acad. Sci. USA* 81:5951-5955, (1984).
Skolnick, et al., *Trends in Biotech* 18(1):34-39, (2000).
Smith, et al., *Molecular and Cellular Biology* 3(12):2156-2165, (1983).
Smith, et al., *Gene* 67:31-40, (1988).
Smith, et al., *Nature Biotech* 15:1222-1223, (1997).
Stiff, P., et al., *Transfusion* 23:500-503, (1983).
Strieter, M., et al., *Science* 253:1467-1469, (1989).
Strieter, R., et al., *J. Biol. Chem.* 264(18):10621-10626, (1989).
Tashiro, K., et al., *Science* 261:600-603, (1993).
Thelen, M., et al., *FASEB J.* 2:2702-2706, (1988).
To, L., et al., *Bone Marrow Transplantation* 9:277-284, (1992).
Tokuda, A., et al., *J. Immunol.* 164:2745-2751, (2000).
Tratschin, J., et al., *J. Virology* 51(3):611-619, (1984).
Tratschin, J., et al., *Mol. Cell Biol.* 4(10):2072-2081, (1984).
Tratschin, J., et al., *Mol. Cell Biol.* 5(11):3251-3260, (1985).
von Tscharner, V., et al., *Nature* 324:369-372, (1986).
Tsuji, T., et al., *Proc. Nat'l. Acad. Sci.* 87:8835-8839, (1990).
Tudan, et al., *J. Med. Chem* 45(10):2024-2031, (2002).
Unemori, E., et al., *J. Biol. Chem.* 268(2):1338-1342, (1992).
Verfaillie, C., et al., *J. Exp. Med.* 172:509-520, (1990).
Viera, H., et al., *Proceedings of the Fifth ACM International Workshops on Web Information and Data Management* 37-44, (2003).
Wada, et al., *Nucleic Acids Research* 20:2111-2118, (1992).
Wang, J., et al., *Blood* 92(3):756-764, (1998).
Wang, W., et al., *The Journal of Biological Chemistry* 275(29):22313-22323, (2000).
Warringa, R., et al., *Blood* 77(12):2694-2700, (1991).
Weber, F., et al., *Annals Neur.* 44(1):27-34, (1998).
Wells, J.A., *Biochemistry* 29(37):8509-8517, (1990).
Wess, G., et al., *Tetrahedron Letters*, 33(2):195-198, (1992).
Wess, G., et al., *Tetrahedron Letters*, 34(5):817-818, (1993).
Wilson, J., et al., *Proc. Nat'l. Acad. Sci.* 85:3014-3018, (1988).
Wilson, J., et al., *J. Biol. Chem.* 267(2):963-967, (1992).
Winoto, et al., *The EMBO J.* 8(3):729-733, (1989).
Wolfe, J., et al., *Science* 247:1465-1468, (1990).
Wondisford, F., et al., *Molecular Endocrinology* 2(1):32-39, (1988).

Wu, G., et al., *J. Biol. Chem.* 263(29):14621-14624, (1988).
Ying, S., et al., *J. Immunol.* 163:6321-6329, (1999).
Yla-Herttuala, S., et al., *Proc. Natl. Acad. Sci.* 88:5252-5256, (1991).
Yu, C., et al., *Immunology* 95:480-487, (1998).
Zhong, et al., *Exp. Hematol* 32:470-475, (2004).
Zhou, N., et al., *Biochemistry 2000* 39:3782-3787, (2000).
Zhu, Y., et al., *SIGMOD Conference 431-442*, (2004).
Zsebo, K., et al., *Cell* 63:195-201, (1990).

Anonymous, "Oracle 8i Designing and Tuning for Performance," (Dec. 1999) Ch. 19, pp. 12-18, Release 2 (8.1.8.), <http://download-west.oracle.com/docs/cd/A81042_01DOC/server.818/a76992/ch19_mem.htm> and Ch. 27, <http://download_west.oracle.com/docs/cd/A81042_01/DOC/server.818/a76981/ch127.htm>.
Hessing et al., *Blood*, 94(1o Suppl.):p. 100A (1999).
Hunter et al., *Blood*, 86(12):4400-4408 (1995).

\* cited by examiner

SDF-1 SEQUENCES

Seq. ID NO: 1 (SDF-1α; Human)
    a) LENGTH: 67 amino acids
    b) TYPE: amino acid
    c) TOPOLOGY: linear
    d) MOLECULE TYPE: protein (recombinant and/or pegylated)

```
KPVSL SYRCP CRFFE SHVAR ANVKH LKILN TPNCA LQIVA RLKNN
1     6     11    16    21    26    31    36    41

NRQVC IDPKL KWIQE YLEKA LN
46    51    56    61    66
```

Seq. ID NO: 3 (SDF-1 Precursor, PBSF; Human)

a) LENGTH: 93 amino acids
    b) TYPE: amino acid
    c) TOPOLOGY: linear
    d) MOLECULE TYPE: protein (recombinant and or pegylated)

```
MNAKV VVVLV LVLTA LCLSD GKPVS LSYRC PCRFF ESHVA RANVK
1     6     11    16    21    26    31    36    41

HLKIL NTPNC ALQIV ARLKN NNRQV CIDPK LKWIQ EYLEK ALNKR
46    51    56    61    66    71    76    81    86

FKM
91
```

Seq. ID NO: 4 (SDF-1β; Human)

a) LENGTH: 93 amino acids
    b) TYPE: amino acid
    c) TOPOLOGY: linear
    d) MOLECULE TYPE: protein (recombinant and or pegylated)

```
MNAKV VVVLV LVLTA LCLSD GKPVS LSYRC PCRFF ESHVA RANVK
1     6     11    16    21    26    31    36    41

HLKIL NTPNC ALQIV ARLKN NNRQV CIDPK LKWIQ EYLEK ALNKR
46    51    56    61    66    71    76    81    86

FKM
91
```

Fig. 15

Compound A-like Analogs (SEQ ID NO:809)

K[D-P]VSLSYRCPCRFFGGGGLKWIQEYLEKALN-NH$_2$

K[D-P]VSLSYRCPCRFF-(CH$_2$)$_n$-LKWIQEYLEKALN-NH$_2$

[PEG-Lys]PVSLSYRCPCRFFGGGGLKWIQEYLEKALN-NH$_2$

[PEG-Lys]PVS[D-L]SYRCPCRFF-(CH$_2$)$_n$-LKWIQEYLEKALN-NH$_2$
with PEG MW =500-20000

KPVSLSYR<u>A</u>P<u>F</u>RFFGGGGLKWIQEYLEKALN-NH$_2$

KPVSLSYR<u>A</u>P<u>F</u>RFF-(CH$_2$)$_n$-LKWIQEYLEKALN-NH$_2$

[PEG-Lys]PVSLSYR<u>A</u>P<u>F</u>RFFGGGGLKWIQEYLEKALN-NH$_2$

[PEG-Lys]PVSLSYR<u>A</u>P<u>F</u>RFF-(CH$_2$)$_n$-LKWIQEYLEKALN-NH$_2$
with PEG MW =500-20000

K[D-P]VS[D-L]SYRCPCRFFGGGGLKWIQEYLEKALN-NH$_2$

K[D-P]VS[D-L]SYRCPCRFF-(CH$_2$)$_n$-LKWIQEYLEKALN-NH$_2$

Fig. 17A

KPVSLSYR<u>A</u>P<u>H</u>RFFGGGGLKWIQEYLEKALN-NH$_2$

KPVSLSYR<u>A</u>P<u>H</u>RFF-(CH$_2$)$_n$-LKWIQEYLEKALN-NH$_2$

[PEG-Lys]PVSLSYR<u>A</u>P<u>H</u>RFFGGGGLKWIQEYLEKALN-NH$_2$

[PEG-Lys]PVSLSYR<u>A</u>P<u>H</u>RFF-(CH$_2$)$_n$-LKWIQEYLEKALN-NH$_2$
with PEG(Polyethyleneglycol chain) MW=500-20000

K[D-P]VS[D-L]SYR<u>A</u>P<u>H</u>RFFGGGGLKWIQEYLEKALN-NH$_2$

K[D-P]VS[D-L]SYR<u>A</u>P<u>H</u>RFF-(CH$_2$)$_n$LKWIQEYLEKALN-NH$_2$

KPVSLSYR<u>A</u>P<u>W</u>RFFGGGGLKWIQEYLEKALN-NH$_2$

KPVSLSYR<u>A</u>P<u>W</u>RFF-(CH$_2$)$_n$-LKWIQEYLEKALN-NH$_2$

[PEG-Lys]PVSLSYR<u>A</u>P<u>W</u>RFFGGGGLKWIQEYLEKALN-NH$_2$

[PEG-Lys]PVSLSYR<u>A</u>P<u>W</u>RFF-(CH$_2$)$_n$-LKWIQEYLEKALN-NH$_2$
with PEG(Polyethyleneglycol chain) MW=500-20000

K[D-P]VS[D-L]SYR<u>A</u>P<u>W</u>RFFGGGGLKWIQEYLEKALN-NH$_2$

K[D-P]VS[D-L]SYR<u>A</u>P<u>W</u>RFF-(CH$_2$)$_n$-LKWIQEYLEKALN-NH$_2$

Fig. 17B

KPVSLSYRFPARFF‾GGGGL‾KWIQEYLEKALN-NH₂

KPVSLSYRFPARFF-(CH₂)ₙ-L‾KWIQEYLEKALN-NH₂

[PEG-Lys]PVSLSYRFPARFFGGGGL‾KWIQEYLEKALN-NH₂

[PEG-Lys]PVSLSYRFPARFF-(CH₂)ₙ-L‾KWIQEYLEKALN-NH₂ with PEG(Polyethyleneglycol chain) MW=500-20000

K[D-P]VS[D-L]SYRFPARFFGGGGL‾KWIQEYLEKALN-NH₂

K[D-P]VS[D-L]SYRFPARFF-(CH₂)ₙL‾KWIQEYLEKALN-NH₂

Fig. 17C

KPVSLSYRHPARFFGGGGLKWIQEYLEKALN-NH₂

KPVSLSYRHPARFF-(CH₂)ₙ-LKWIQEYLEKALN-NH₂

[PEG-Lys]PVSLSYRHPARFFGGGGLKWIQEYLEKALN-NH₂

[PEG-Lys]PVSLSYRHPARFF-(CH₂)ₙ-LKWIQEYLEKALN-NH₂
with PEG(Polyethyleneglycol chain) MW=500-20000

K[D-P]VS[D-L]SYRHPARFFGGGGLKWIQEYLEKALN-NH₂

K[D-P]VS[D-L]SYRHPARFF-(CH₂)ₙ-LKWIQEYLEKALN-NH₂

KPVSLSYRWPARFFGGGGLKWIQEYLEKALN-NH₂

KPVSLSYRWPARFF-(CH₂)ₙ-LKWIQEYLEKALN-NH₂

[PEG-Lys]PVSLSYRWPARFFGGGGLKWIQEYLEKALN-NH₂

[PEG-Lys]PVSLSYRWPARFF-(CH₂)ₙ-LKWIQEYLEKALN-NH₂
with PEG(Polyethyleneglycol chain) MW=500-20000

K[D-P]VS[D-L]SYRWPARFFGGGGLKWIQEYLEKALN-NH₂

K[D-P]VS[D-L]SYRWPARFF-(CH₂)ₙ-LKWIQEYLEKALN-NH₂

Fig. 17D

KPVSLSYR*A*P*Y*RFFGGGGLKWIQEYLEKALN-NH₂

KPVSLSYR*A*P*Y*RFF-(CH₂)ₙ-LKWIQEYLEKALN-NH₂

[PEG-Lys]PVSLSYR*A*P*Y*RFFGGGGLKWIQEYLEKALN-NH₂

[PEG-Lys]PVSLSYR*A*P*Y*RFF-(CH₂)ₙ-LKWIQEYLEKALN-NH₂ with PEG(Polyethyleneglycol chain) MW=500-20000

K[D-P]VS[D-L]SYR*A*P*Y*RFFGGGGLKWIQEYLEKALN-NH₂

K[D-P]VS[D-L]SYR*A*P*Y*RFF-(CH₂)ₙ-LKWIQEYLEKALN-NH₂

KPVSLSYR*Y*P*Y*RFFGGGGLKWIQEYLEKALN-NH₂

KPVSLSYR*Y*P*Y*RFF-(CH₂)ₙ-LKWIQEYLEKALN-NH₂

[PEG-Lys]PVSLSYR*Y*P*Y*RFFGGGGLKWIQEYLEKALN-NH₂

[PEG-Lys]PVSLSYR*Y*P*Y*RFF-(CH₂)ₙ-LKWIQEYLEKALN-NH₂ with PEG(Polyethyleneglycol chain) MW=500-20000

K[D-P]VS[D-L]SYR*Y*P*Y*RFFGGGGLKWIQEYLEKALN-NH₂

K[D-P]VS[D-L]SYR*Y*P*Y*RFF-(CH₂)ₙ-LKWIQEYLEKALN-NH₂

Fig. 17E

KPVSLSYRYPARFFGGGGLKWIQEYLEKALN-NH₂

KPVSLSYRYPARFF-(CH₂)ₙ-LKWIQEYLEKALN-NH₂

[PEG-Lys]PVSLSYRYPARFFGGGGLKWIQEYLEKALN-NH₂

[PEG-Lys]PVSLSYRYPARFF-(CH₂)ₙ-LKWIQEYLEKALN-NH₂ with PEG(Polyethyleneglycol chain) MW=500-20000

K[D-P]VS[D-L]SYRYPARFFGGGGLKWIQEYLEKALN-NH₂

K[D-P]VS[D-L]SYRYPARFF-(CH₂)ₙ-LKWIQEYLEKALN-NH₂

KPVSLSYRFPFRFFGGGGLKWIQEYLEKALN-NH₂

KPVSLSYRFPFRFF-(CH₂)ₙ-LKWIQEYLEKALN-NH₂

[PEG-Lys]PVSLSYRFPFRFFGGGGLKWIQEYLEKALN-NH₂

[PEG-Lys]PVSLSYRFPFRFF-(CH₂)ₙ-LKWIQEYLEKALN-NH₂ with PEG(Polyethyleneglycol chain) MW=500-20000

K[D-P]VS[D-L]SYRFPFRFFGGGGLKWIQEYLEKALN-NH₂

K[D-P]VS[D-L]SYRFPFRFF-(CH₂)ₙ-LKWIQEYLEKALN-NH₂

Fig. 17F

KPVSLSYR<u>H</u>P<u>H</u>RFFGGGGLKWIQEYLEKALN-NH₂

KPVSLSYR<u>H</u>P<u>H</u>RFF-(CH₂)ₙ-LKWIQEYLEKALN-NH₂

[PEG-Lys]PVSLSYR<u>H</u>P<u>H</u>RFFGGGGLKWIQEYLEKALN-NH₂

[PEG-Lys]PVSLSYR<u>H</u>P<u>H</u>RFF-(CH₂)ₙ-LKWIQEYLEKALN-NH₂
with PEG(Polyethyleneglycol chain) MW=500-20000

K[D-P]VS[D-L]SYR<u>H</u>P<u>H</u>RFFGGGGLKWIQEYLEKALN-NH₂

K[D-P]VS[D-L]SYR<u>H</u>P<u>H</u>RFF-(CH₂)ₙ-LKWIQEYLEKALN-NH₂

KPVSLSYR<u>W</u>P<u>W</u>RFFGGGGLKWIQEYLEKALN-NH₂

KPVSLSYR<u>W</u>P<u>W</u>RFF-(CH₂)ₙ-LKWIQEYLEKALN-NH₂

[PEG-Lys]PVSLSYR<u>W</u>P<u>W</u>RFFGGGGLKWIQEYLEKALN-NH₂

[PEG-Lys]PVSLSYR<u>W</u>P<u>W</u>RFF-(CH₂)ₙ-LKWIQEYLEKALN-NH₂
with PEG(Polyethyleneglycol chain) MW=500-20000

K[D-P]VS[D-L]SYR<u>W</u>P<u>W</u>RFFGGGGLKWIQEYLEKALN-NH₂

K[D-P]VS[D-L]SYR<u>W</u>P<u>W</u>RFF-(CH₂)ₙ-LKWIQEYLEKALN-NH₂

Fig. 17G

Compound K-like Analogs   (SEQ ID NO:803)

K[D-P]VS[D-L]SYRCPCRFFGGGGLKWIQEYLEKALN-NH₂

K[D-P]VS[D-L]SYRCPCRFF-(CH₂)ₙ-LKWIQEYLEKALN-NH₂

[PEG-Lys]PVSLSYRCPCRFFGGGGLKWIQEYLEKALN-NH₂

[PEG-Lys]PVSLSYRCPCRFF-(CH₂)ₙ-LKWIQEYLEKALN-NH₂
with PEG MW =500-20000

KPVSLSYRAPFRFFGGGGLKWIQEYLEKALN-NH₂

KPVSLSYRAPFRFF-(CH₂)ₙ-LKWIQEYLEKALN-NH₂

[PEG-Lys]PVSLSYRAPFRFFGGGGLKWIQEYLEKALN-NH₂

[PEG-Lys]PVSLSYRAPFRFF-(CH₂)ₙ-LKWIQEYLEKALN-NH₂
with PEG MW =500-20000

K[D-P]VS[D-L]SYRCPCRFFGGGGLKWIQEYLEKALN-NH₂

K[D-P]VS[D-L]SYRCPCRFF-(CH₂)ₙ-LKWIQEYLEKALN-NH₂

Fig. 17H

KPVSLSYR*A*P*H*RFFGGGGLKWIQEYLEKALN-NH₂

KPVSLSYR*A*P*H*RFF-(CH₂)ₙ-LKWIQEYLEKALN-NH₂

[PEG-Lys]PVSLSYR*A*P*H*RFFGGGGLKWIQEYLEKALN-NH₂

[PEG-Lys]PVSLSYR*A*P*H*RFF-(CH₂)ₙ-LKWIQEYLEKALN-NH₂ with PEG(Polyethyleneglycol chain) MW=500-20000

K[D-P]VS[D-L]SYR*A*P*H*RFFGGGGLKWIQEYLEKALN-NH₂

K[D-P]VS[D-L]SYR*A*P*H*RFF-(CH₂)ₙ-LKWIQEYLEKALN-NH₂

KPVSLSYR*A*P*W*RFFGGGGLKWIQEYLEKALN-NH₂

KPVSLSYR*A*P*W*RFF-(CH₂)ₙ-LKWIQEYLEKALN-NH₂

[PEG-Lys]PVSLSYR*A*P*W*RFFGGGGLKWIQEYLEKALN-NH₂

[PEG-Lys]PVSLSYR*A*P*W*RFF-(CH₂)ₙ-LKWIQEYLEKALN-NH₂ with PEG(Polyethyleneglycol chain) MW=500-20000

K[D-P]VS[D-L]SYR*A*P*W*RFFGGGGLKWIQEYLEKALN-NH₂

K[D-P]VS[D-L]SYR*A*P*W*RFF-(CH₂)ₙ-LKWIQEYLEKALN-NH₂

Fig. 17I

KPVSLSYR<u>F</u><u>A</u>RFFGGGGLKWIQEYLEKALN-NH₂ (bracket over F...Q)

KPVSLSYR<u>F</u><u>A</u>RFF-(CH₂)ₙ-LKWIQEYLEKALN-NH₂

[PEG-Lys]PVSLSYR<u>F</u><u>A</u>RFFGGGGLKWIQEYLEKALN-NH₂

[PEG-Lys]PVSLSYR<u>F</u><u>A</u>RFF-(CH₂)ₙ-LKWIQEYLEKALN-NH₂
with PEG(Polyethyleneglycol chain) MW=500-20000

K[D-P]VS[D-L]SYR<u>F</u><u>A</u>RFFGGGGLKWIQEYLEKALN-NH₂

K[D-P]VS[D-L]SYR<u>F</u><u>A</u>RFF-(CH₂)ₙ-LKWIQEYLEKALN-NH₂

KPVSLSYR<u>H</u><u>P</u><u>A</u>RFFGGGGLKWIQEYLEKALN-NH₂

KPVSLSYR<u>H</u><u>P</u><u>A</u>RFF-(CH₂)ₙ-LKWIQEYLEKALN-NH₂

[PEG-Lys]PVSLSYR<u>H</u><u>P</u><u>A</u>RFFGGGGLKWIQEYLEKALN-NH₂

[PEG-Lys]PVSLSYR<u>H</u><u>P</u><u>A</u>RFF-(CH₂)ₙ-LKWIQEYLEKALN-NH₂
with PEG(Polyethyleneglycol chain) MW=500-20000

K[D-P]VS[D-L]SYR<u>H</u><u>P</u><u>A</u>RFFGGGGLKWIQEYLEKALN-NH₂

K[D-P]VS[D-L]SYR<u>H</u><u>P</u><u>A</u>RFF-(CH₂)ₙ-LKWIQEYLEKALN-NH₂

Fig. 17J

KPVSLSYR<u>W</u>P<u>A</u>RFFGGGGLKWIQEYLEKALN-NH₂

KPVSLSYR<u>W</u>P<u>A</u>RFF-(CH₂)ₙ-LKWIQEYLEKALN-NH₂

[PEG-Lys]PVSLSYR<u>W</u>P<u>A</u>RFFGGGGLKWIQEYLEKALN-NH₂

[PEG-Lys]PVSLSYR<u>W</u>P<u>A</u>RFF-(CH₂)ₙ-LKWIQEYLEKALN-NH₂
with PEG(Polyethyleneglycol chain) MW=500-20000

K[D-P]VS[D-L]SYR<u>W</u>P<u>A</u>RFFGGGGLKWIQEYLEKALN-NH₂

K[D-P]VS[D-L]SYR<u>W</u>P<u>A</u>RFF-(CH₂)ₙ-LKWIQEYLEKALN-NH₂

KPVSLSYR<u>A</u>P<u>Y</u>RFFGGGGLKWIQEYLEKALN-NH₂

KPVSLSYR<u>A</u>P<u>Y</u>RFF-(CH₂)ₙ-LKWIQEYLEKALN-NH₂

[PEG-Lys]PVSLSYR<u>A</u>P<u>Y</u>RFFGGGGLKWIQEYLEKALN-NH₂

[PEG-Lys]PVSLSYR<u>A</u>P<u>Y</u>RFF-(CH₂)ₙ-LKWIQEYLEKALN-NH₂
with PEG(Polyethyleneglycol chain) MW=500-20000

K[D-P]VS[D-L]SYR<u>A</u>P<u>Y</u>RFFGGGGLKWIQEYLEKALN-NH₂

K[D-P]VS[D-L]SYR<u>A</u>P<u>Y</u>RFF-(CH₂)ₙ-LKWIQEYLEKALN-NH₂

Fig. 17K

KPVSLSYRYPYRFFGGGGLKWIQEYLEKALN-NH₂

KPVSLSYRYPYRFF-(CH₂)ₙ-LKWIQEYLEKALN-NH₂

[PEG-Lys]PVSLSYRYPYRFFGGGGLKWIQEYLEKALN-NH₂

[PEG-Lys]PVSLSYRYPYRFF-(CH₂)ₙ-LKWIQEYLEKALN-NH₂
with PEG(Polyethyleneglycol chain) MW=500-20000

K[D-P]VS[D-L]SYRYPYRFFGGGGLKWIQEYLEKALN-NH₂

K[D-P]VS[D-L]SYRYPYRFF-(CH₂)ₙ-LKWIQEYLEKALN-NH₂

KPVSLSYRYPARFFGGGGLKWIQEYLEKALN-NH₂

KPVSLSYRYPARFF-(CH₂)ₙ-LKWIQEYLEKALN-NH₂

[PEG-Lys]PVSLSYRYPARFFGGGGLKWIQEYLEKALN-NH₂

[PEG-Lys]PVSLSYRYPARFF-(CH₂)ₙ-LKWIQEYLEKALN-NH₂
with PEG(Polyethyleneglycol chain) MW=500-20000

K[D-P]VS[D-L]SYRYPARFFGGGGLKWIQEYLEKALN-NH₂

K[D-P]VS[D-L]SYRYPARFF-(CH₂)ₙ-LKWIQEYLEKALN-NH₂

Fig. 17L

KPVSLSYRFPFRFFGGGGLKWIQEYLEKALN-NH₂

KPVSLSYRFPFRFF-(CH₂)ₙ-LKWIQEYLEKALN-NH₂

[PEG-Lys]PVSLSYRFPFRFFGGGGLKWIQEYLEKALN-NH₂

[PEG-Lys]PVSLSYRFPFRFF-(CH₂)ₙ-LKWIQEYLEKALN-NH₂ with PEG(Polyethyleneglycol chain) MW=500-20000

K[D-P]VS[D-L]SYRFPFRFFGGGGLKWIQEYLEKALN-NH₂

K[D-P]VS[D-L]SYRFPFRFF-(CH₂)ₙ-LKWIQEYLEKALN-NH₂

KPVSLSYRHPHRFFGGGGLKWIQEYLEKALN-NH₂

KPVSLSYRHPHRFF-(CH₂)ₙ-LKWIQEYLEKALN-NH₂

[PEG-Lys]PVSLSYRHPHRFFGGGGLKWIQEYLEKALN-NH₂

[PEG-Lys]PVSLSYRHPHRFF-(CH₂)ₙ-LKWIQEYLEKALN-NH₂ with PEG(Polyethyleneglycol chain) MW=500-20000

K[D-P]VS[D-L]SYRHPHRFFGGGGLKWIQEYLEKALN-NH₂

K[D-P]VS[D-L]SYRHPHRFF-(CH₂)ₙ-LKWIQEYLEKALN-NH₂

Fig. 17M

KPVSLSYR<u>W</u>P<u>W</u>RFFGGGGLKWIQEYLEKALN-NH$_2$

KPVSLSYR<u>W</u>P<u>W</u>RFF-(CH$_2$)$_n$-LKWIQEYLEKALN-NH$_2$

[PEG-Lys]PVSLSYR<u>W</u>P<u>W</u>RFFGGGGLKWIQEYLEKALN-NH$_2$

[PEG-Lys]PVSLSYR<u>W</u>P<u>W</u>RFF-(CH$_2$)$_n$-LKWIQEYLEKALN-NH$_2$ with PEG(Polyethyleneglycol chain) MW=500-20000

K[D-P]VS[D-L]SYR<u>W</u>P<u>W</u>RFFGGGGLKWIQEYLEKALN-NH$_2$

K[D-P]VS[D-L]SYR<u>W</u>P<u>W</u>RFF-(CH$_2$)$_n$-LKWIQEYLEKALN-NH$_2$

Fig. 17N

CHEMOKINE MIMETICS SYNTHESIS AND THEIR USE

CROSS-REFERENCE TO RELATED APPLICATIONS

This application is a divisional of U.S. application Ser. No. 10/222,703, filed Aug. 16, 2002, now abandoned which is a continuation-in-part of U.S. application Ser. No. 10/086,177, filed Feb. 26, 2002, now U.S. Pat. No. 7,378,098 which is a continuation-in-part of U.S. application Ser. No. 09/835,107, filed Apr. 12, 2001, now abandoned which claims the benefit of provisional U.S. Application No. 60/232,425, Sep. 14, 2000, Canadian Application Nos. 2,335,109, filed Feb. 23, 2001, and 2,305,036, filed Apr. 12, 2000; U.S. application Ser. No. 10/222,703 claims the benefit of U.S. provisional Application Nos. 60/373,628, filed Apr. 17, 2002, and 60/373,629, filed Apr. 17, 2002; and each of these applications, specifically enumerated above with the exception of the Canadian Applications, is hereby incorporated by reference in its entirety.

SEQUENCE LISTING

The instant application contains a "lengthy" sequence listing which has been submitted as a CD-R in lieu of a printed paper copy and is hereby incorporated by reference in its entirety. The CD-R versions, recorded on Oct. 20, 2004, are labeled CRF, Copy 1, and Copy 2, and each contains only one identical 1.13 MB file (5929602U.APP).

FIELD OF THE INVENTION

This invention relates to the preparation, design, derivation, and use of peptide agonists and antagonists of the chemokine SDF-1. In one aspect, this invention also relates to the preparation, design, or use of chemokine analogs for human SDF-1 or SDF-1/MIP-1α hybrids, or derivatives thereof.

BACKGROUND OF THE INVENTION

Chemokines (chemoattractant cytokines) are a family of homologous serum proteins of between 7 and 16 kDa, which were originally characterized by their ability to induce migration of leukocytes. Most chemokines have four characteristic cysteines (Cys), and depending on the motif displayed by the first two cysteines, they have been classified into CXC or alpha, CC or beta, C or gamma, and CX3C or delta chemokine classes. Two disulfide bonds are formed between the first and third cysteines and between the second and fourth cysteines. Clark-Lewis and co-workers reported that, at least for IL-8, the disulfide bridges are critical for chemokine activity (Clark-Lewis et al., J. Biol. Chem. 269:16075-16081, 1994). The only exception to the four cysteine motif is lymphotactin, which has only two cysteine residues. Thus, lymphotactin retains a functional structure with only one disulfide bond.

In addition, the CXC, or alpha, subfamily has been divided into two groups depending on the presence of the ELR motif (Glu-Leu-Arg) preceding the first cysteine: the ELR-CXC chemokines and the non-ELR-CXC chemokines (see, e.g. Clark-Lewis, supra, and Belperio et al., "CXC Chemokines in Angiogenesis," J. Leukoc. Biol. 68:1-8, 2000).

ELR-CXC chemokines, such as IL-8, are generally strong neutrophil chemoattractants while non-ELR chemokines, such as IP-10, and SDF-1, predominantly recruit lymphocytes. CC chemokines, such as RANTES, MIP-1-alpha, MCP-1, generally function as chemoattractants for monocytes, basophils, eosinophils, and T-cells but not neutrophils. In general, chemokines are chemotactic agents that recruit leukocytes to the sites of injuries.

SDF-1

Stromal cell-derived factor-1 (SDF-1 or CXCL12) is a CXC chemokine that demonstrates in vitro activity with respect to lymphocytes and monocytes but not neutrophils. It is a highly potent in vivo chemoattractant for mononuclear cells. SDF-1 has been shown to induce intracellular actin polymerization in lymphocytes, and to induce a transient elevation of cytoplasmic calcium in some cells.

MIP-1α

Macrophage inflammatory protein-1α (MIP-1α, MIP-1-alpha or CCL3) is a factor produced by macrophages in response to their stimulation by bacterial endotoxins. It activates neutrophils, eosinophils, and basophils and appears to play a role in inflammation. Additionally, it is especially potent as a basophil agonist, and appears to act through a rapid rise in intracellular calcium, and causes the release of histamine, sulfido-leukotrienes, and also plays a role in chemotaxis. MIP-1-alpha may also act to inhibit stem cell proliferation.

Chemokine Receptors

The receptors for chemokines are G-protein coupled seven-transmembrane receptors. Based on the chemokine class they bind, the receptors have been named CXCR1, CXCR2, CXCR3, CXCR4, and CXCR5 (all of which bind CXC chemokines); CCR1 through CCR9 (all of which bind CC chemokines); XCR1 (which binds the C chemokine, Lptn); and CX3CR1 (which binds the CX3C chemokine, fractalkine or neurotactin). (See Table 1.)

The chemokines and their receptors have received increasing attention in the last few years. In addition to their role in HIV pathogenesis, it is now clear that chemokines participate in many pathological conditions such as inflammation and diseases or conditions associated with autoimmune responses. They also play a very important role in normal homeostasis, including lymphoid development and migration. Further, they play a role in the growth of bones. As a result of their role in various physiological processes and pathological conditions and diseases, chemokines have many important potential therapeutic applications.

TABLE 1

| Chemokine receptors | Human chemokine ligands |
| --- | --- |
| CXCR1 | IL-8, GCP-2 |
| CXCR2 | IL-8, GCP-2, Gro α, Gro β, Gro γ, ENA-78, PBP |
| CXCR3 | MIG, EP-10, I-TAC |
| CXCR4 | SDF-1/PBSF |
| CCR1 | MEP-1 α, MIP-1 β, RANTES, HCC-1, 2, 3, and 4 |
| CCR2 | MCP-1, MCP-2, MCP-3, MCP-4 |
| CCR3 | Eotaxin-1 eotaxin-2, MCP-3 |
| CCR4 | TARC, MDC, MIP-1 α, RANTES |
| CCR5 | MIP-1 α, MIP-1 β, RANTES |
| CCR6 | MIP-3 α/LARC |
| CCR7 | MP-3 β/ELC, 6Ckine/LC |
| CCR8 | I-309 |
| CCR9 | TECK |
| CCR10 | CCL27, CCL28(hMEC) |

Certain agonists of CXCR4 have been described in International Publication No. WO 01/76615 A2 entitled "CXCR4 Agonist Treatment of Hematopoietic Cells" (PCT/CA01/00540). Certain antagonists of CXCR4 have been described in International Publication No. WO 01/85196 A2 entitled "CXCR4 Antagonist Treatment of Hematopoietic Cells"

(PCT/CA01/00659. Both PCT publications are hereby incorporated by reference herein, including any drawings, figures and tables.

SUMMARY OF THE INVENTION

The embodiments of the present invention generally encompass compositions comprising SDF-1 mimetics and methods of using them to modulate an activity of a cell having an SDF-1 receptor. In some embodiments, the methods comprise binding the SDF-1 receptor of the cell with an SDF-1 mimetic consisting of the following structure:

$R_N$—HN—Xaa$_3$-Pro-Val-Ser-Leu-Ser-Tyr-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-$R_C$ (SEQ ID NO:10).

$R_N$ can be an N-terminal modifier that comprises a component selected from a group consisting of hydrogen, poly(ethylene glycol), a biochemical label, a radiolabel, an acyl group, an acetyl group, and an N-terminal modifier capable of reducing the ability of the SDF-1 mimetic to act as a substrate for aminopeptidases. $R_C$ can be a C-terminal modifier that comprises a component selected from a group consisting of a hydroxyl group, poly(ethylene glycol), a biochemical label, a radiolabel, an amido group, and a C-terminal modifier capable of reducing the ability of the SDF-1 mimetic to act as a substrate for carboxypeptidases. The Xaa$_1$, Xaa$_2$, and Xaa$_3$ variables can be each independently selected from a group consisting of (a) any natural amino acid; and (b) any non-natural amino acid having the structure H$_2$N—$Z_A$—COOH, where $Z_A$ is selected from a group consisting of saturated and unsaturated aliphatics and heteroaliphatics consisting of 20 or fewer carbon atoms, cycloalkyl amines, and fused cycloalkyl amines. The linker can be selected from a group consisting of (a) any combination of four natural amino acids; and (b) any non-natural amino acid having the structure H$_2$N—$Z_A$—COOH, wherein $Z_A$ is selected from a group consisting of saturated and unsaturated aliphatics and heteroaliphatics consisting of 20 or fewer carbon atoms that are optionally substituted with a hydroxyl, carboxyl, carbonyl, thiol, amino, amido, imino, or an aromatic group having from 5 to 7 members in the ring; and —(CH$_2$)$_n$—, wherein n is an integer ranging from 9 to 14.

The cell can be a hematopoietic cell selected from a group consisting of hematopoietic stem cells, hematopoietic progenitor cells, primitive granulocytes, primitive erythroid cells, leukocytes, and neutrophils. In some embodiments, the binding can reduce the rate of multiplication of the cell or, where the cell is a quiescent cell, the binding can repress the activation of the quiescent cell.

In some embodiments, the invention is a method of modulating an activity of hematopoietic cells in a subject comprising administering an effective amount of a composition comprising the SDF-1 mimetic to the subject. In these embodiments, the administering can result in mobilizing the hematopoietic cells; and enhancing recovery of the hematopoietic cells following chemotherapy, such as by reducing the rate of multiplication of the hematopoietic cells to inhibit the effect of a cytotoxic agent on the hematopoietic cells during the chemotherapy. In some embodiments, the administering can result in enhancing an engraftment of the hematopoietic cells from the subject in a second subject. In some embodiments, the method further comprises administering a second agent, wherein the administering of the second agent is sequential or concurrent to the administering of the composition comprising the SDF-1 mimetic. In these embodiments, the second agent can include G-CSF.

In some embodiments, the invention includes method of increasing the number of hematopoietic cells circulating in the blood of a subject, wherein the method comprises administering an effective amount of a composition comprising an SDF-1 mimetic.

BRIEF DESCRIPTION OF THE DRAWINGS

FIG. 2 also shows the CXCR4 receptor binding of the SDF-1 peptide analogs (competing ligands described in Example 2). SUP-T1 cells were preincubated with SDF-1 or peptide analogs for 30 min, then were assessed for $^{125}$I-SDF-1 binding following 2 hr of incubation with $^{125}$I-SDF-1. 0.5 nM $^{125}$I-SDF-1 was added in the presence of SDF-1 or the indicated analogs at the concentrations illustrated. The results are expressed as percentages of the maximal specific binding that was determined without competing ligand, and are the representative results from three independent experiments.

FIG. 15 shows the amino acid sequences of human SDF-1.alpha, SDF-1 Precursor (PBSF) and SDF-1.beta.

FIG. 17 lists the sequences of several chemokine analogs.

DETAILED DESCRIPTION OF THE INVENTION

Figure 1A:
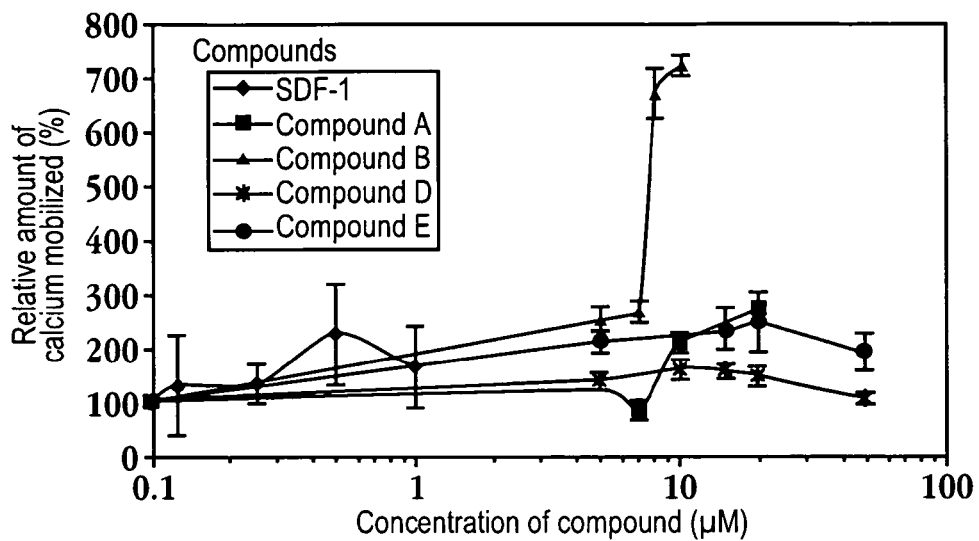
FIG. 1 shows the induction of $[Ca^{2+}]_i$ mobilization by SDF-1 and SDF-1 analogs. Fluo-4,AM loaded SUP-T1 cells ($5 \times 10^6$/ml) were stimulated with SDF-1, Compound A (SEQ ID NO:809), Compound B (SEQ ID NO:810), Compound C (SEQ ID NO:811), Compound D (SEQ ID NO:812) and Compound E (SEQ ID NO:813) at the concentrations indicated. The values represent the mean+/−one S.D. of one representative experiment from three independent experiments.

The invention relates to the design, preparation, derivation, and use of chemokine analogs. In one aspect, this invention is directed to the synthesis or use of chemokine analogs that bind to receptors for human SDF-1. In another aspect, the invention is directed to the synthesis, design, derivation, or use of agonist or antagonist analogs of human SDF-1, and derivatives thereof. In a further aspect, the invention is directed to the synthesis, design, derivation, or use of agonist or antagonist analogs of hybrids of human SDF-1 and human MIP-1α, and derivatives thereof. The invention is not limited in its application to the details of structures and the arrangements of components set forth in the following description or illustrated in the drawings and the figures. Further, it should be understood that in any claimed list or claimed Markush group, those schooled in the art will recognize that the invention is also thereby described in terms of any individual member or subgroup of members of the list or Markush group. Additionally, any individual member of the claimed list or the claimed Markush group can be removed from the list or Markush group without affecting the patentability of the remaining members.

The sequence of the human CXC chemokine, SDF-1, is shown below:

SDF-1: Lys-Pro-Val-Ser-Leu-Ser-Tyr-Arg-Cys-Pro-Cys-Arg-Phe-Phe-Glu-Ser-His-Val-Ala-Arg-Ala-Asn-Val-Lys-His-Leu-Lys-Ile-Leu-Asn-Thr-Pro-Asn-Cys-Ala-Leu-Gln-Ile-Val-Ala-Arg-Leu-Lys-Asn-Asn-Asn-Arg-Gln-Val-Cys-Ile-Asp-Pro-Lys-Leu-Lys-Trp-Ile-Gln-Glu-Tyr-Leu-Glu-Lys-Ala-Leu-Asn (SEQ ID NO:1)

The sequence of the CC chemokine, MIP-1α, is shown below:

MIP-1α Ser-Leu-Ala-Ala-Asp-Thr-Pro-Thr-Ala-Cys-Cys-Phe-Ser-Tyr-Thr-Ser-Arg-Gln-Ile-Pro-Gln-Asn-Phe-Ile-Ala-Asp-Tyr-Phe-Glu-Thr-Ser-Ser-Gln-Cys-Ser-Lys-Pro-Gly-Val-Ile-Phe-Leu-Thr-Lys-Arg-Ser-Arg-Gln-Val-Cys-Ala-Asp-Pro-Ser-Glu-Glu-Trp-Val-Gln-Lys-Tyr-Val-Ser-Asp-Leu-Glu-Leu-Ser-Ala (SEQ ID NO:2)

The N-terminal region of chemokines is involved in the binding and activating site of its receptor, as well as is the carboxy terminal region. In the native compounds, the beta sheet structure that connects the two termini appears to play a role in the stabilization of the chemokine and assuring that the termini are in the proper conformation.

Examples of these chemokine analogs are compounds containing structures corresponding to various regions or portions of the chemokines. In preferred embodiments, the chemokine analog comprises an N-terminal region and a C-terminal region joined together by means of a linker. In other preferred embodiments, the amino acid residues of the chemokine or chemokine analog are cyclized, e.g., by etherification of lysine and serine residues or by other means described infra or known in the art. In still other preferred embodiments, the chemokine analog comprises an amino acid sequence derived from the wild-type chemokine sequence but with one or more of the cysteines replaced with another amino acid. Other preferred embodiments include chemokine analogs comprising an N-terminal region, an internal region containing up to three anti-parallel β-sheets, a C-terminal region containing an α-helical structure, a combination of the N- and C-terminal regions linked together directly, a combination of a N-terminal and internal region, or a combination of an internal and C-terminal region, or finally a combination of N-terminal, internal and C-terminal regions. The regions selected from the N-terminal, internal and C-terminal regions may be 5, 6, 7, 8, 9, 10, 11, 12, 13, 14, 15, 16, 17, 20, 25, 30, 35, 40, 41, or 45 amino acids in length.

Examples of such chemokine analogs also include a cross combination of one chemokine region to a different region from a different chemokine in the same or different family. These examples include, but are not limited to, regions of SDF-1 and MIP-1α.

Chemokine analogs of the invention are useful for treating inflammatory conditions, autoimmune disorders, cancer, vaccine production and blood cell recovery following chemotherapy or stem cell mobilization, as well as graft rejection, bacterial infection, viral infection, vascular conditions (for example, atherosclerosis, restenosis, systemic lupus erythematosis, and ischemia-reperfusion), sepsis, tumorigenesis, and angiogenesis. Inflammatory conditions contemplated by the present invention include both acute and chronic inflammatory diseases. Chemokine analogs of the inventions may also prove useful in conducting gene therapy; one manner they may assist in the methods of gene therapy is through an arrest of the cell cycle.

Examples of uses of the chemokine analogs in some aspects of the invention include, but are not limited to, treatment or management of arthritis, asthma, colitis/illeitis, psoriasis, atherosclerosis and the like. Examples of uses of the chemokine analogs in some aspects of the invention to treat or manage autoimmune conditions include, but are not limited to rheumatoid arthritis and multiple sclerosis and other immunological diseases. Examples of uses of the chemokine analogs in some aspects of the invention to treat or manage cancer include, but are not limited to, treatment or management of human malignancy/cancer cell metastasis and relapses. Examples of uses of the chemokine analogs in some aspects of the invention to assist in blood cell recovery include, but are not limited to, blood cell elevation after chemotherapy/radiotherapy and stem cell mobilization for transplant. Examples of uses of the chemokine analogs in some aspects of the invention for vaccine production includes, but are not limited to, enhancement in humoral antibody production, increases in antigen presenting T-cells, increases in dendritic cells and immunological features known as vaccine induction. Chemokines may also play a role in osteoporosis and thus it may be treated by chemokine analogs of the invention. Chemokine analogs of the present invention may also prove useful in treating genetic disease through gene therapy.

As defined by the present invention a chemokine analog acts as an agonist or an antagonist to a corresponding native chemokine. The agonistic activity of the chemokine analogs of the present invention includes mimicking of biological activity induced by corresponding native chemokines. The antagonistic activity of the chemokine analogs of the present invention includes inhibition of biological activity induced by native chemokines. The instant invention also encompasses a chemokine analog that acts as an agonist or an antagonist to a different native chemokine.

Peptides

In this application, the products of the present invention are referred to by various terms, including "analogs" of the present invention, "chemokine mimetics" and "chemokine analogs." These terms are used interchangeably and denote equivalent compounds. The term "polypeptides of the present invention," may also be used herein to refer to chemokine analogs. Further, chemokine analogs of the present invention comprise a structure which comprises a sequence selected from the group set forth as SEQ ID NO:9 through SEQ ID NO:818 and thus may comprise additional elements such as R-group substituents and a linker selected from the possibilities set forth in the instant invention.

As defined by the present invention, biological activity refers to the biological activity of the native chemokines, as defined and measured by the scientific reports known to those of skill in the art, and exemplified in the following review articles (Bruce, L. et al., "Radiolabeled Chemokine binding assays," Methods in Molecular Biology (2000) vol. 138, pp 129-134, Raphaele, B. et al. "Calcium Mobilization," Methods in Molecular Biology (2000) vol. 138, pp 143-148, Paul D. Ponath et al., "Transwell Chemotaxis," Methods in Molecular Biology (2000) vol. 138, pp 113-120 Humana Press. Totowa, N.J.). Aspects of biological activity include, but are not limited to, receptor binding, chemotaxis, calcium mobilization, and other activities recognized by those of skill in the art.

The amino acids are identified in the present application by the conventional one-letter and three-letter abbreviations as indicated below, and are preceded by "L-" to indicate their L-form and by "D-" to refer to their D form. These abbreviations are generally accepted in the peptide art as recommended by the IUPAC-IUB commission in biochemical nomenclature:

| Alanine | A | Ala | Leucine | L | Leu |
|---|---|---|---|---|---|
| Arginine | R | Arg | Lysine | K | Lys |
| Asparagine | N | Asn | Methionine | M | Met |
| Aspartic acid | D | Asp | Phenylalanine | F | Phe |
| Cysteine | C | Cys | Proline | P | Pro |
| Glutamic acid | E | Glu | Serine | S | Ser |
| Glutamine | Q | Gln | Threonine | T | Thr |
| Glycine | G | Gly | Tryptophan | W | Trp |
| Histidine | H | His | Tyrosine | Y | Tyr |
| Isoleucine | I | Ile | Valine | V | Val |
| Ornithine | O | Orn | | | |

Peptide sequences set out herein are written according to the generally accepted convention whereby the N-terminal amino acid is on the left and the C-terminal amino acid is on the right.

Chemokine mimetics of the invention may include chemokine derivatives or chemokine analogs and their derivatives, such as C-terminal hydroxymethyl derivatives, O-modified derivatives (e.g., C-terminal hydroxymethyl benzyl ether), N-terminally modified derivatives including substituted amides such as alkylamides and hydrazides and compounds in which a C-terminal phenylalanine residue is replaced with a phenethylamide analogue (e.g., Ser-Ile-phenethylamide as an analog of the tripeptide Ser-Ile-Phe), glycosylated chemokine derivatives, polyethylene glycol modified derivatives, or biotinylated derivatives.

Modifying Groups

In one aspect of the invention, the chemokine analogs of the invention, such as chemokine analogs derived from SDF-1, may be coupled directly or indirectly to at least one modifying group. In some aspects of the invention, the term "modifying group" is intended to include structures that are directly attached to the peptidic structure (e.g., by covalent bonding or covalent coupling), as well as those that are indirectly attached to the peptidic structure (e.g., by a stable non-covalent bond association or by covalent coupling through a linker to additional amino acid residues). In other aspects of the invention the term "modifying group" may also refer to mimetics, analogs or derivatives thereof, which may flank the SDF-1 or MIP-1α core peptidic structure. For example, the modifying group can be coupled to the amino-terminus or carboxy-terminus of a SDF-1 or MIP-1α peptidic structure, or to a peptidic or peptidomimetic region flanking the core structure. Alternatively, the modifying group can be coupled to a side chain of at least one amino acid residue of a SDF-1 or MIP-1α peptidic structure, or to a peptidic or peptidomimetic region flanking the core domain (e.g., through the epsilon amino group of a lysyl residue(s); through the carboxyl group of an aspartic acid residue(s) or a glutamic acid residue(s); through a hydroxy group of a tyrosyl residue(s), a serine residue(s) or a threonine residue(s); or any other suitable reactive group on an amino acid side chain). In other aspects, modifying groups covalently coupled to the peptidic structure can be attached by means and using methods well known in the art for linking chemical structures, including, for example, amide, alkylamino, sulfide, carbamate or urea bonds.

In some embodiments, the modifying group may comprise a cyclic, heterocyclic or polycyclic group. The term "cyclic group," as used herein, includes cyclic saturated or unsaturated (i.e., aromatic) group having from 3 to 10; from 4 to 8; or 5, 6, or 7 carbon atoms. Exemplary non-aromatic cyclic groups include cyclopropyl, cyclobutyl, cyclopentyl, cyclohexyl, and cyclooctyl. The term "heterocyclic group" includes optionally substituted, saturated or unsaturated, three- to eight-membered cyclic structures in which one or more skeletal atoms is oxygen, nitrogen, sulfur, or combinations thereof. Cyclic groups or heterocyclic groups may be unsubstituted or substituted at one or more ring positions. A cyclic group may for example be substituted with halogens, alkyls, cycloalkyls, alkenyls, alkynyls, aryls, heterocycles, hydroxyls, aminos, nitros, thiols amines, imines, amides, phosphonates, phosphines, carbonyls, carboxyls, silyls, ethers, thioethers, sulfonyls, sulfonates, selenoethers, ketones, aldehydes, esters, —$CF_3$, —CN. The cyclic group may also be linked to a substituent, such as halogens, alkyls, cycloalkyls, alkenyls, alkynyls, aryls, heterocycles, hydroxyls, aminos, nitros, thiols amines, imines, amides, phosphonates, phosphines, carbonyls, carboxyls, silyls, ethers, thioethers, sulfonyls, sulfonates, selenoethers, ketones, aldehydes, esters, —$CF_3$, —CN by means of a saturated or unsaturated chain of 1, 2, 3, 4, 5, 6, 7, 8, or more carbon atoms; additionally one or more of the carbon atoms may be replaced with an oxygen, nitrogen, or sulfur atoms.

In one embodiment of the invention, chemokine analogs are designed by replacing all or part of the beta-sheet domain with a linker. In a different embodiment, all or a portion of the amino-terminal domain and all or a portion of the carboxy-terminal domain of a chemokine or chemokine analog are connected with a linker. In another embodiment, the chemokine analogs are designed so that there are cyclized by covalent modification between residues of the peptide. In still other embodiments, the cysteines of the chemokines are replaced by other amino acids. In further embodiments, chemokine analogs are modified by attaching modifying groups to the amino terminus.

Definitions

The term "heterocyclic group" includes cyclic saturated, unsaturated and aromatic groups having from 3 to 10; from 4 to 8; or 5, 6, or 7 carbon atoms, wherein the ring structure includes about one or more heteroatoms. Heterocyclic groups include pyrrolidine, oxolane, thiolane, imidazole, oxazole, piperidine, piperazine, and morpholine. The heterocyclic ring may be substituted at one or more positions with such substituents as, for example, halogens, alkyls, cycloalkyls, alkenyls, alkynyls, aryls, arylalkyls, other heterocycles, hydroxyl, amino, nitro, thiol, amines, imines, amides, phosphonates, phosphines, carbonyls, carboxyls, silyls, ethers, thioethers, sulfonyls, selenoethers, ketones, aldehydes, esters, —$CF_3$, —CN. Heterocycles may also be bridged or fused to other cyclic groups as described below. A linker may also link the heterocyclic group to such substituents as, for example, halogens, alkyls, cycloalkyls, alkenyls, alkynyls, aryls, arylalkyls, heterocycles, hydroxyls, aminos, nitros, thiols amines, imines, amides, phosphonates, phosphines, carbonyls, carboxyls, silyls, ethers, thioethers, sulfonyls, sulfonates, selenoethers, ketones, aldehydes, esters, —$CF_3$, or —CN.

The term "polycyclic group" as used herein is intended to refer to two or more saturated, unsaturated or aromatic cyclic rings in which two or more carbons are common to two adjoining rings, so that the rings are "fused rings." Rings that are joined through non-adjacent atoms are termed "bridged" rings. Each of the rings of the polycyclic group may be substituted with such substituents as described above, as for example, halogens, alkyls, cycloalkyls, alkenyls, alkynyls, arylalkyls, hydroxyl, amino, nitro, thiol, amines, imines, amides, phosphonates, phosphines, carbonyls, carboxyls, silyls, ethers, thioethers, sulfonyls, selenoethers, ketones, aldehydes, esters, —$CF_3$, or —CN.

The term "alkyl" refers to a saturated aliphatic groups, including straight chain alkyl groups, branched-chain alkyl groups, cycloalkyl (alicyclic) groups, alkyl substituted cycloalkyl groups, and cycloalkyl substituted alkyl groups. In some embodiments, a straight chain or branched chain alkyl has 20 or fewer carbon atoms in its backbone ($C_1$-$C_{20}$ for straight chain, $C_3$-$C_{20}$ for branched chain), or 10 or fewer carbon atoms. In some embodiments, cycloalkyls may have from 4-10 carbon atoms in their ring structure, such as rings made from 5, 6 or 7. Unless the number of carbons is otherwise specified, "lower alkyl" as used herein means an alkyl group, as defined above, having from one to ten carbon atoms in its backbone structure. Likewise, "lower alkenyl" and "lower alkynyl" have chain lengths of ten or less carbons.

The term "alkyl" (or "lower alkyl") as used throughout the specification and claims is intended to include both "unsubstituted alkyls" and "substituted alkyls," the latter of which refers to alkyl moieties having substituents replacing a hydrogen on one or more carbons of the hydrocarbon backbone. Such substituents can include, for example, halogen, hydroxyl, carbonyl (such as carboxyl, ketones (including alkylcarbonyl and arylcarbonyl groups)), and esters (including alkyloxycarbonyl and aryloxycarbonyl groups), thiocarbonyl, acyloxy, alkoxyl, phosphoryl, phosphonate, phosphinate, amino, acylamino, amido, amidine, imino, cyano, nitro, azido, sulfhydryl, alkylthio, sulfate, sulfonate, sulfamoyl, sulfonamido, heterocyclyl, aralkyl, or an aromatic or heteroaromatic moiety. The moieties substituted on the hydrocarbon chain can themselves be substituted, if appropriate. For instance, the substituents of a substituted alkyl may include substituted and unsubstituted forms of aminos, azidos, iminos, amidos, phosphoryls (including phosphonates and phosphinates), sulfonyls (including sulfates, sulfonamidos, sulfamoyls and sulfonates), and silyl groups, as well as ethers, alkylthios, carbonyls (including ketones, aldehydes, carboxylates, and esters), —CF$_3$, —CN and the like. Exemplary substituted alkyls are described below. Cycloalkyls can be further substituted with alkyls, alkenyls, alkoxys, alkylthios, aminoalkyls, carbonyl-substituted alkyls, —CF$_3$, —CN, and the like.

The terms "alkenyl" and "alkynyl" refer to unsaturated aliphatic groups analogous in length and possible substitution to the alkyls described above, but that contain at least one double or triple bond respectively.

The term "aralkyl," as used herein, refers to an alkyl or alkylenyl group substituted with at least one aryl group. Exemplary aralkyls include benzyl (i.e., phenylmethyl), 2-naphthylethyl, 2-(2-pyridyl)propyl, 5-dibenzosuberyl, and the like.

The term "alkylcarbonyl," as used herein, refers to —C(O)-alkyl. Similarly, the term "arylcarbonyl" refers to —C(O)-aryl. The term "alkyloxycarbonyl," as used herein, refers to the group —C(O)—O-alkyl, and the term "aryloxycarbonyl" refers to —C(O)—O-aryl. The term "acyloxy" refers to —O—C(O)—R$_7$, in which R$_7$ is alkyl, alkenyl, alkynyl, aryl, aralkyl or heterocyclyl.

The term "amino," as used herein, refers to —N(R$_\alpha$)(R$_\beta$), in which R$_\alpha$ and R$_\beta$ are each independently hydrogen, alkyl, alkyenyl, alkynyl, aralkyl, aryl, or in which R$_\alpha$ and R$_\beta$ together with the nitrogen atom to which they are attached form a ring having 4-8 atoms. Thus, the term "amino," as used herein, includes unsubstituted, monosubstituted (e.g., monoalkylamino or monoarylamino), and disubstituted (e.g., dialkylamino or alkylarylamino) amino groups. The term "amido" refers to —C(O)—N(R$_\alpha$)(R$_\beta$), in which R$_\alpha$ and R$_\beta$ are as defined above. The term "acylamino" refers to —N(R'$_\alpha$)C(O)—R$_7$, in which R$_7$ is as defined above and R'$_\beta$ is alkyl.

As used herein, the term "nitro" means —NO$_2$; the term "halogen" designates —F, —Cl, —Br or —I; the term "sulfhydryl" means —SH; and the term "hydroxyl" means —OH.

The term "aryl" as used herein includes 5-, 6- and 7-membered aromatic groups that may include from zero to four heteroatoms in the ring, for example, phenyl, pyrrolyl, furyl, thiophenyl, imidazolyl, oxazole, thiazolyl, triazolyl, pyrazolyl, pyridyl, pyrazinyl, pyridazinyl and pyrimidinyl, and the like. Those aryl groups having heteroatoms in the ring structure may also be referred to as "aryl heterocycles" or "heteroaromatics." The aromatic ring can be substituted at one or more ring positions with such substituents as described above, as for example, halogen, azide, alkyl, aralkyl, alkenyl, alkynyl, cycloalkyl, hydroxyl, amino, nitro, sulfhydryl, imino, amido, phosphonate, phosphinate, carbonyl, carboxyl, silyl, ether, alkylthio, sulfonyl, sulfonamido, ketone, aldehyde, ester, a heterocyclyl, an aromatic or heteroaromatic moiety, —CF$_3$, —CN, or the like. Aryl groups can also be part of a polycyclic group. For example, aryl groups include fused aromatic moieties such as naphthyl, anthracenyl, quinolyl, indolyl, and the like.

Modifying groups may also include groups comprising biochemical labels or structures, such as biotin, fluorescent-label-containing groups, light scattering or plasmon resonant particle, a diethylene-triaminepentaacetyl group, a (O)-menthoxyacetyl group, a N-acetylneuraminyl group, a cholyl structure or an iminobiotinyl group. A chemokine analog or chemokine mimetic compound may be modified at its carboxy terminus with a cholyl group according to methods known in the art. Cholyl derivatives and analogs may also be used as modifying groups. For example, a preferred cholyl derivative is Aic (3-(O-aminoethyl-iso)-cholyl), which has a free amino group that can be used to further modify the chemokine mimetic compound. A modifying group may be a "biotinyl structure," which includes biotinyl groups and analogues and derivatives thereof (such as a 2-iminobiotinyl group). In another embodiment, the modifying group may comprise a fluorescent-label group, e.g., a fluorescein-containing group, such as a group derived from reacting a SDF-1-derived peptidic structure with 5-(and 6-)-carboxyfluorescein, succinimidyl ester or fluorescein isothiocyanate. The chemokine analogs may also be modified by attaching other fluorescent labels including rhodamine, dichlorotriazinylamine fluorescein, dansyl chloride or phycoerythrin and energy transfer fluorescent dyes or fluorescent ion indicators. In various other embodiments, the modifying group(s) may comprise an N-acetylneuraminyl group, a trans-4-cotininecarboxyl group, a 2-imino-1-imidazolidineacetyl group, an (S)-(-)-indoline-2-carboxyl group, a (-)-menthoxyacetyl group, a 2-norbornaneacetyl group, a γ-oxo-5-acenaphthenebutyryl, a (-)-2-oxo-4-thiazolidinecarboxyl group, a tetrahydro-3-furoyl group, a 2-iminobiotinyl group, a diethylenetriaminepentaacetyl group, a 4-morpholinecarbonyl group, a 2-thiopheneacetyl group or a 2-thiophenesulfonyl group. In other embodiments, light scattering groups, magnetic groups, nanogold, other proteins, a solid matrix, radiolabels, or carbohydrates may be attached.

In still other aspects, the modifying group may be an oligomer, for example, polyethylene glycol, an oligonucleotide, a polypeptide (which may or may not be derived from a chemokine) or one moiety of a binding pair.

Functional Enhancement

A chemokine analog compound of the invention may be further modified to alter the specific properties of the compound while retaining the desired functionality of the compound. For example, in one embodiment, the compound may be modified to alter a pharmacokinetic property of the compound, such as in vivo stability, bioavailability or half-life. The compound may be modified to label the compound with a detectable substance. The compound may be modified to couple the compound to an additional therapeutic moiety. To further chemically modify the compound, such as to alter its pharmacokinetic properties, reactive groups can be derivatized. For example, when the modifying group is attached to the amino-terminal end of the SDF-1 core domain, the carboxy-terminal end of the compound may be further modified. Potential C-terminal modifications include those that reduce the ability of the compound to act as a substrate for carboxypeptidases. Examples of C-terminal modifiers include an amide group, an ethylamide group and various non-natural amino acids, such as D-amino acids, β-alanine, C-terminal decarboxylation, and a C-terminal alcohol. Alternatively, when the modifying group is attached to the carboxy-terminal end of the aggregation core domain, the amino-terminal end of the compound may be further modified, for example, to reduce the ability of the compound to act as a substrate for aminopeptidases.

Chemokine analogs of the invention may be modified by the addition of polyethylene glycol (PEG). PEG modification may lead to improved circulation time, improved solubility, improved resistance to proteolysis, reduced antigenicity and immunogenicity, improved bioavailability, reduced toxicity, improved stability, and easier formulation (For a review, see, Francis et al., International Journal of Hematology, 68:1-18, 1998). PEGylation may also result in a substantial reduction in bioactivity.

The chemokine analogs of the invention may also be coupled to a radioisotope such as yttrium-90 or iodine-131 for therapeutic purposes (see, e.g., DeNardo et al., Cancer 94(4 Suppl): 1275-86, 2002; Kaltsas et al., Ann Oncol 12 Suppl 2:S47-50, 2001).

Detection Enhancement

A chemokine mimetic compound can be further modified to label the compound by reacting the compound with a detectable substance. In some aspects of the invention, suitable detectable substances include various enzymes, prosthetic groups, fluorescent materials, luminescent materials, light scattering or plasmon resonant materials, and radioactive materials. Examples of suitable enzymes include horseradish peroxidase, alkaline phosphatase, beta-galactosidase, or acetylcholinesterase. Examples of suitable prosthetic groups, which are members of a binding pair and are capable of forming complexes include streptavidin/biotin, avidin/biotin and an antigen/antibody complex (e.g., rabbit IgG and anti-rabbit IgG). Examples of suitable fluorescent materials include umbelliferone, fluorescein, fluorescein isothiocyanate, rhodamine, dichlorotriazinylamine fluorescein, dansyl chloride or phycoerythrin and energy transfer fluorescent dyes. An example of a luminescent material includes luminol. Examples of light scattering or plasmon resonant materials include gold or silver particles and quantum dots. Examples of suitable radioactive material include $^{14}C$, $^{123}I$, $^{124}I$, $^{125}I$, $^{131}I$, Tc99m, $^{35}S$ or $^{3}H$. A chemokine mimetic compound may be radioactively labeled with $^{14}C$, either by incorporation of $^{14}C$ into the modifying group or one or more amino acid structures in the chemokine mimetic compound. Labeled chemokine mimetic compounds may be used to assess the in vivo pharmacokinetics of the compounds, as well as to detect disease progression or propensity of a subject to develop a disease, for example for diagnostic purposes. Tissue distribution chemokine receptors can be detected using a labeled chemokine mimetic compound either in vivo or in an in vitro sample derived from a subject. For use as an in vivo diagnostic agent, a chemokine mimetic compound of the invention may be labeled with radioactive technetium or iodine. A modifying group can be chosen that provides a site at which a chelation group for the label can be introduced, such as the Aic derivative of cholic acid, which has a free amino group. For example, a tyrosine residue within the SDF-1 sequence may be substituted with radioactive iodotyrosyl. Any of the various isotopes of radioactive iodine may be incorporated to create a diagnostic or therapeutic agent. $^{123}I$ (half-life=13.2 hours) may be used for whole body scintigraphy, $^{124}I$ (half life=4 days) may be used for positron emission tomography (PET), $^{125}I$, (half life=60 days) may be used for metabolic turnover studies and $^{131}I$ (half life=8 days) may be used for whole body counting and delayed low resolution imaging studies.

Prodrug

In an alternative chemical modification, a chemokine analog compound of the invention may be prepared in a "pro-drug" form, wherein the compound itself does not act as a chemokine analog agonist, but rather is capable of being transformed, upon metabolism in vivo, into a chemokine analog agonist or antagonist compound as defined herein. For example, in this type of compound, the modifying group can be present in a prodrug form that is capable of being converted upon metabolism into the form of an active chemokine analog agonist. Such a prodrug form of a modifying group is referred to herein as a "secondary modifying group." A variety of strategies are known in the art for preparing peptide prodrugs that limit metabolism in order to optimize delivery of the active form of the peptide-based drug.

Synthesis

Chemokine analog compounds of the invention may be prepared by standard techniques known in the art. A peptide or polypeptide component of a chemokine analog may comprise, at least in part, a peptide synthesized using standard techniques (such as those described by Clark-Lewis, I., Dewald, B., Loetscher, M., Moser, B., and Baggiolini, M., (1994) J. Biol. Chem., 269, 16075-16081). Automated peptide synthesizers are commercially available (e.g., Advanced ChemTech Model 396; Milligen/Biosearch 9600, Applied-biosystems/Pioneer). Peptides and polypeptides may be assayed for chemokine receptor agonist or antagonist activity in accordance with standard methods. Peptides and polypeptides may be purified by HPLC and analyzed by mass spectrometry. Peptides and polypeptides may be dimerized. In one embodiment, peptides and polypeptides are dimerized via a disulfide bridge formed by gentle oxidation of the cysteines using 10% DMSO in water. Following HPLC purification, dimer formation may be verified, by mass spectrometry. One or more modifying groups may be attached to a chemokine analog of the invention-derived peptidic component by standard methods, for example, using methods for reaction through an amino group (e.g., the alpha-amino group at the amino-terminus of a peptide), a carboxyl group (e.g., at the carboxy terminus of a peptide), a hydroxyl group (e.g., on a tyrosine, serine or threonine residue) or other suitable reactive group on an amino acid side chain.

In alternative embodiments, analogs derived from the C-terminal and N-terminal joined by a linker could be cyclized in their C-terminal moiety using side-chain to side-chain; side-chain to scaffold or, scaffold to scaffold cyclization. In some embodiments, lactamization, etherification, or RCM (Ring Closing Metathesis) are used to carry out this reaction.

For instance, chemokine analogs may be cyclized using a lactam formation procedure by joining the γ-carboxy side chain or the α-carboxy moiety of glutamate (Glu) residue to the ε-amino side chain of lysine (Lys) residue, as indicated in the following sequences by underlining of linked residues. Lactams may for example be formed between glutamic acid and lysine (Lys) in the C-terminal portion of the polypeptide (which does not correspond necessarily with the numbering of that residue in the native sequence). In further alternatives, a lysine (Lys) may be substituted by ornithine (Orn) or any other (L or D) natural or (L or D) non-natural amino acid having an amino group on its side chain. Similarly, glutamate (Glu) may for example be substituted with aspartate (Asp), denoted by nomenclature such as (Glu→Asp) indicating a substitution in a given position in the peptide wherein aspartate replaces glutamate.

The chemokine analogs of the invention include chemokine polypeptide sequences wherein one or more of the amino acids have been replaced by a conservative amino acid substitution. The term "conservative amino acid substitution" refers to a polypeptide chain in which one of the amino acid residues is replaced with an amino acid residue having a side chain with similar properties. Families of amino acid residues having side chains with similar properties are well known in the art. These families include amino acids with acidic side chains (e.g., aspartic acid, glutamic acid), basic side chains (e.g., lysine, arginine, histidine), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, an amino acid residue in a chemokine is replaced with another amino acid residue from the same side chain family.

In some aspects of the chemokine analogs of the invention, the analogs contain a linker, having the denoted structure [linker], wherein the linker has the following structure: $H_2N-Z_A-COOH$ as defined below.

SDF-1 Compounds:

Preferred embodiments of linear SDF-1 chemokine analogs of the present invention corresponding to a portion of the N-terminal region joined with a linker to the C-terminal region of SDF-1 having the following structures:

SDF-1(1-14)-[linker]-SDF-1(55-67) acid or amide f1) RHN-Lys-Pro-Val-Ser-Leu-Ser-Tyr-Arg-$Xaa_1$-Pro-$Xaa_2$-Arg-Phe-Phe-[linker]-Leu-Lys-Trp-Ile-Gln-Glu-Tyr-Leu-Glu-Lys-Ala-Leu-Asn-$(OH)NH_2$ (SEQ ID NO:9)

f2) RHN-$Xaa_3$-Pro-Val-Ser-Leu-Ser-Tyr-Arg-$Xaa_1$-Pro-$Xaa_2$-Arg-Phe-Phe-[linker]-Leu-Lys-Trp-Ile-Gln-Glu-Tyr-Leu-Glu-Lys-Ala-Leu-Asn-$(OH)NH_2$ (SEQ ID NO:10)

f3) RHN-Lys-$Xaa_3$-Val-Ser-Leu-Ser-Tyr-Arg-$Xaa_1$-Pro-$Xaa_2$-Arg-Phe-Phe-[linker]-Leu-Lys-Trp-Ile-Gln-Glu-Tyr-Leu-Glu-Lys-Ala-Leu-Asn-$(OH)NH_2$ (SEQ ID NO:11)

f4) RHN-Lys-Pro-$Xaa_3$-Ser-Leu-Ser-Tyr-Arg-$Xaa_1$-Pro-$Xaa_2$-Arg-Phe-Phe-[linker]-Leu-Lys-Trp-Ile-Gln-Glu-Tyr-Leu-Glu-Lys-Ala-Leu-Asn-$(OH)NH_2$ (SEQ ID NO:12)

f5) RHN-Lys-Pro-Val-$Xaa_3$-Leu-Ser-Tyr-Arg-$Xaa_1$-Pro-$Xaa_2$-Arg-Phe-Phe-[linker]-Leu-Lys-Trp-Ile-Gln-Glu-Tyr-Leu-Glu-Lys-Ala-Leu-Asn-$(OH)NH_2$ (SEQ ID NO:13)

f6) RHN-Lys-Pro-Val-Ser-$Xaa_3$-Ser-Tyr-Arg-$Xaa_1$-Pro-$Xaa_2$-Arg-Phe-Phe-[linker]-Leu-Lys-Trp-Ile-Gln-Glu-Tyr-Leu-Glu-Lys-Ala-Leu-Asn-$(OH)NH_2$ (SEQ ID NO:14)

f7) RHN-Lys-Pro-Val-Ser-Leu-$Xaa_3$-Tyr-Arg-$Xaa_1$-Pro-$Xaa_2$-Arg-Phe-Phe-[linker]-Leu-Lys-Trp-Ile-Gln-Glu-Tyr-Leu-Glu-Lys-Ala-Leu-Asn-$(OH)NH_2$ (SEQ ID NO:15)

f8) RHN-Lys-Pro-Val-Ser-Leu-Ser-$Xaa_3$-Arg-$Xaa_1$-Pro-$Xaa_2$-Arg-Phe-Phe-[linker]-Leu-Lys-Trp-Ile-Gln-Glu-Tyr-Leu-Glu-Lys-Ala-Leu-Asn-$(OH)NH_2$ (SEQ ID NO:16)

f9) RHN-Lys-Pro-Val-Ser-Leu-Ser-Tyr-$Xaa_3$-$Xaa_1$-Pro-$Xaa_2$-Arg-Phe-Phe-[linker]-Leu-Lys-Trp-Ile-Gln-Glu-Tyr-Leu-Glu-Lys-Ala-Leu-Asn-$(OH)NH_2$ (SEQ ID NO:17)

f10) RHN-Lys-Pro-Val-Ser-Leu-Ser-Tyr-Arg-$Xaa_1$-Pro-$Xaa_2$-$Xaa_4$-Phe-Phe-[linker]-Leu-Lys-Trp-Ile-Gln-Glu-Tyr-Leu-Glu-Lys-Ala-Leu-Asn-$(OH)NH_2$ (SEQ ID NO:18)

f11) RHN-$Xaa_3$-Pro-Val-Ser-Leu-Ser-Tyr-Arg-$Xaa_1$-Pro-$Xaa_2$-$Xaa_4$-Phe-Phe-[linker]-Leu-Lys-Trp-Ile-Gln-Glu-Tyr-Leu-Glu-Lys-Ala-Leu-Asn-$(OH)NH_2$ (SEQ ID NO:19)

f12) RHN-Lys-$Xaa_3$-Val-Ser-Leu-Ser-Tyr-Arg-$Xaa_1$-Pro-$Xaa_2$-$Xaa_4$-Phe-Phe-[linker]-Leu-Lys-Trp-Ile-Gln-Glu-Tyr-Leu-Glu-Lys-Ala-Leu-Asn-$(OH)NH_2$ (SEQ ID NO:20)

f13) RHN-Lys-Pro-$Xaa_3$-Ser-Leu-Ser-Tyr-Arg-$Xaa_1$-Pro-$Xaa_2$-$Xaa_4$-Phe-Phe-[linker]-Leu-Lys-Trp-Ile-Gln-Glu-Tyr-Leu-Glu-Lys-Ala-Leu-Asn-$(OH)NH_2$ (SEQ ID NO:21)

f14) RHN-Lys-Pro-Val-$Xaa_3$-Leu-Ser-Tyr-Arg-$Xaa_1$-Pro-$Xaa_2$-$Xaa_4$-Phe-Phe-[linker]-Leu-Lys-Trp-Ile-Gln-Glu-Tyr-Leu-Glu-Lys-Ala-Leu-Asn-$(OH)NH_2$ (SEQ ID NO:22)

f15) RHN-Lys-Pro-Val-Ser-$Xaa_3$-Ser-Tyr-Arg-$Xaa_1$-Pro-$Xaa_2$-$Xaa_4$-Phe-Phe-[linker]-Leu-Lys-Trp-Ile-Gln-Glu-Tyr-Leu-Glu-Lys-Ala-Leu-Asn-$(OH)NH_2$ (SEQ ID NO:23)

f16) RHN-Lys-Pro-Val-Ser-Leu-$Xaa_3$-Tyr-Arg-$Xaa_1$-Pro-$Xaa_2$-$Xaa_4$-Phe-Phe-[linker]-Leu-Lys-Trp-Ile-Gln-Glu-Tyr-Leu-Glu-Lys-Ala-Leu-Asn-$(OH)NH_2$ (SEQ ID NO:24)

f17) RHN-Lys-Pro-Val-Ser-Leu-Ser-$Xaa_3$-Arg-$Xaa_1$-Pro-$Xaa_2$-$Xaa_4$-Phe-Phe-[linker]-Leu-Lys-Trp-Ile-Gln-Glu-Tyr-Leu-Glu-Lys-Ala-Leu-Asn-$(OH)NH_2$ (SEQ ID NO:25)

f18) RHN-Lys-Pro-Val-Ser-Leu-Ser-Tyr-$Xaa_3$-$Xaa_1$-Pro-$Xaa_2$-$Xaa_4$-Phe-Phe-[linker]-Leu-Lys-Trp-Ile-Gln-Glu-Tyr-Leu-Glu-Lys-Ala-Leu-Asn-$(OH)NH_2$ (SEQ ID NO:26)

f19) RHN-Lys-Pro-Val-Ser-Leu-Ser-Tyr-Arg-$Xaa_1$-Pro-$Xaa_2$-Arg-$Xaa_4$-Phe-[linker]-Leu-Lys-Trp-Ile-Gln-Glu-Tyr-Leu-Glu-Lys-Ala-Leu-Asn-$(OH)NH_2$ (SEQ ID NO:27)

f20) RHN-$Xaa_3$-Pro-Val-Ser-Leu-Ser-Tyr-Arg-$Xaa_1$-Pro-$Xaa_2$-Arg-$Xaa_4$-Phe-[linker]-Leu-Lys-Trp-Ile-Gln-Glu-Tyr-Leu-Glu-Lys-Ala-Leu-Asn-$(OH)NH_2$ (SEQ ID NO:28)

f21) RHN-Lys-$Xaa_3$-Val-Ser-Leu-Ser-Tyr-Arg-$Xaa_1$-Pro-$Xaa_2$-Arg-$Xaa_4$-Phe-[linker]-Leu-Lys-Trp-Ile-Gln-Glu-Tyr-Leu-Glu-Lys-Ala-Leu-Asn-$(OH)NH_2$ (SEQ ID NO:29)

f22) RHN-Lys-Pro-$Xaa_3$-Ser-Leu-Ser-Tyr-Arg-$Xaa_1$-Pro-$Xaa_2$-Arg-$Xaa_4$-Phe-[linker]-Leu-Lys-Trp-Ile-Gln-Glu-Tyr-Leu-Glu-Lys-Ala-Leu-Asn-$(OH)NH_2$ (SEQ ID NO:30)

f23) RHN-Lys-Pro-Val-$Xaa_3$-Leu-Ser-Tyr-Arg-$Xaa_1$-Pro-$Xaa_2$-Arg-$Xaa_4$-Phe-[linker]-Leu-Lys-Trp-Ile-Gln-Glu-Tyr-Leu-Glu-Lys-Ala-Leu-Asn-$(OH)NH_2$ (SEQ ID NO:31)

f24) RHN-Lys-Pro-Val-Ser-$Xaa_3$-Ser-Tyr-Arg-$Xaa_1$-Pro-$Xaa_2$-Arg-$Xaa_4$-Phe-[linker]-Leu-Lys-Trp-Ile-Gln-Glu-Tyr-Leu-Glu-Lys-Ala-Leu-Asn-$(OH)NH_2$ (SEQ ID NO:32)

f25) RHN-Lys-Pro-Val-Ser-Leu-$Xaa_3$-Tyr-Arg-$Xaa_1$-Pro-$Xaa_2$-Arg-$Xaa_4$-Phe-[linker]-Leu-Lys-Trp-Ile-Gln-Glu-Tyr-Leu-Glu-Lys-Ala-Leu-Asn-$(OH)NH_2$ (SEQ ID NO:33)

f26) RHN-Lys-Pro-Val-Ser-Leu-Ser-$Xaa_3$-Arg-$Xaa_1$-Pro-$Xaa_2$-Arg-$Xaa_4$-Phe-[linker]-Leu-Lys-Trp-Ile-Gln-Glu-Tyr-Leu-Glu-Lys-Ala-Leu-Asn-$(OH)NH_2$ (SEQ ID NO:34)

f27) RHN-Lys-Pro-Val-Ser-Leu-Ser-Tyr-$Xaa_3$-$Xaa_1$-Pro-$Xaa_2$-Arg-$Xaa_4$-Phe-[linker]-Leu-Lys-Trp-Ile-Gln-Glu-Tyr-Leu-Glu-Lys-Ala-Leu-Asn-$(OH)NH_2$ (SEQ ID NO:35)

f28) RHN-Lys-Pro-Val-Ser-Leu-Ser-Tyr-Arg-Xaa$_1$-Pro-Xaa$_2$-Arg-Phe-Xaa$_4$-[linker]-Leu-Lys-Trp-Ile-Gln-Glu-Tyr-Leu-Glu-Lys-Ala-Leu-Asn-(OH)NH$_2$ (SEQ ID NO:36)

f29) RHN-Xaa$_3$-Pro-Val-Ser-Leu-Ser-Tyr-Arg-Xaa$_1$-Pro-Xaa$_2$-Arg-Phe-Xaa$_4$-[linker]-Leu-Lys-Trp-Ile-Gln-Glu-Tyr-Leu-Glu-Lys-Ala-Leu-Asn-(OH)NH$_2$ (SEQ ID NO:37)

f30) RHN-Lys-Xaa$_3$-Val-Ser-Leu-Ser-Tyr-Arg-Xaa$_1$-Pro-Xaa$_2$-Arg-Phe-Xaa$_4$-[linker]-Leu-Lys-Trp-Ile-Gln-Glu-Tyr-Leu-Glu-Lys-Ala-Leu-Asn-(OH)NH$_2$ (SEQ ID NO:38)

f31) RHN-Lys-Pro-Xaa$_3$-Ser-Leu-Ser-Tyr-Arg-Xaa$_1$-Pro-Xaa$_2$-Arg-Phe-Xaa$_4$-[linker]-Leu-Lys-Trp-Ile-Gln-Glu-Tyr-Leu-Glu-Lys-Ala-Leu-Asn-(OH)NH$_2$ (SEQ ID NO:39)

f32) RHN-Lys-Pro-Val-Xaa$_3$-Leu-Ser-Tyr-Arg-Xaa$_1$-Pro-Xaa$_2$-Arg-Phe-Xaa$_4$-[linker]-Leu-Lys-Trp-Ile-Gln-Glu-Tyr-Leu-Glu-Lys-Ala-Leu-Asn-(OH)NH$_2$ (SEQ ID NO:40)

f33) RHN-Lys-Pro-Val-Ser-Xaa$_3$-Ser-Tyr-Arg-Xaa$_1$-Pro-Xaa$_2$-Arg-Phe-Xaa$_4$-[linker]-Leu-Lys-Trp-Ile-Gln-Glu-Tyr-Leu-Glu-Lys-Ala-Leu-Asn-(OH)NH$_2$ (SEQ ID NO:41)

f34) RHN-Lys-Pro-Val-Ser-Leu-Xaa$_3$-Tyr-Arg-Xaa$_1$-Pro-Xaa$_2$-Arg-Phe-Xaa$_4$-[linker]-Leu-Lys-Trp-Ile-Gln-Glu-Tyr-Leu-Glu-Lys-Ala-Leu-Asn-(OH)NH$_2$ (SEQ ID NO:42)

f35) RHN-Lys-Pro-Val-Ser-Leu-Ser-Xaa$_3$-Arg-Xaa$_1$-Pro-Xaa$_2$-Arg-Phe-Xaa$_4$-[linker]-Leu-Lys-Trp-Ile-Gln-Glu-Tyr-Leu-Glu-Lys-Ala-Leu-Asn-(OH)NH$_2$ (SEQ ID NO:43)

f36) RHN-Lys-Pro-Val-Ser-Leu-Ser-Tyr-Xaa$_3$-Xaa$_1$-Pro-Xaa$_2$-Arg-Phe-Xaa$_4$-[linker]-Leu-Lys-Trp-Ile-Gln-Glu-Tyr-Leu-Glu-Lys-Ala-Leu-Asn-(OH)NH$_2$ (SEQ ID NO:44)

SDF-1 (1-17)-[linker]-SDF-1 (55-67) amide:

f37) RHN-Lys-Pro-Val-Ser-Leu-Ser-Tyr-Arg-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:45)

f38) RHN-Xaa$_3$-Pro-Val-Ser-Leu-Ser-Tyr-Arg-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:46)

f39) RHN-Lys-Xaa$_3$-Val-Ser-Leu-Ser-Tyr-Arg-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:47)

f40) RHN-Lys-Pro-Xaa$_3$-Ser-Leu-Ser-Tyr-Arg-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:48)

f41) RHN-Lys-Pro-Val-Xaa$_3$-Leu-Ser-Tyr-Arg-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:49)

f42) RHN-Lys-Pro-Val-Ser-Xaa$_3$-Ser-Tyr-Arg-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:50)

f43) RHN-Lys-Pro-Val-Ser-Leu-Xaa$_3$-Tyr-Arg-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:51)

f44) RHN-Lys-Pro-Val-Ser-Leu-Ser-Xaa$_3$-Arg-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:52)

f45) RHN-Lys-Pro-Val-Ser-Leu-Ser-Tyr-Xaa$_3$-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:53)

f46) RHN-Lys-Pro-Val-Ser-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:54)

f47) RHN-Xaa$_3$-Pro-Val-Ser-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:55)

f48) RHN-Lys-Xaa$_3$-Val-Ser-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:56)

f49) RHN-Lys-Pro-Xaa$_3$-Ser-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:57)

f50) RHN-Lys-Pro-Val-Xaa$_3$-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:58)

f51) RHN-Lys-Pro-Val-Ser-Xaa$_3$-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:59)

f52) RHN-Lys-Pro-Val-Ser-Leu-Xaa$_3$-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:60)

f53) RHN-Lys-Pro-Val-Ser-Leu-Ser-Xaa$_3$-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:61)

f54) RHN-Lys-Pro-Val-Ser-Leu-Ser-Tyr-Xaa$_3$-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:62)

f55) RHN-Lys-Pro-Val-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:63)

f56) RHN-Xaa$_3$-Pro-Val-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:64)

f57) RHN-Lys-Xaa$_3$-Val-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:65)

f58) RHN-Lys-Pro-Xaa$_3$-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:66)

f59) RHN-Lys-Pro-Val-Xaa$_3$-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:67)

f60)  RHN-Lys-Pro-Val-Ser-Xaa₃-Ser-Tyr-Arg-Xaa₁-Pro-Xaa₂-Arg-Xaa₄-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:68)

f61)  RHN-Lys-Pro-Val-Ser-Leu-Xaa₃-Tyr-Arg-Xaa₁-Pro-Xaa₂-Arg-Xaa₄-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:69)

f62)  RHN-Lys-Pro-Val-Ser-Leu-Ser-Xaa₃-Arg-Xaa₁-Pro-Xaa₂-Arg-Xaa₄-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:70)

f63)  RHN-Lys-Pro-Val-Ser-Leu-Ser-Tyr-Xaa₃-Xaa₁-Pro-Xaa₂-Arg-Xaa₄-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:71)

f64)  RHN-Lys-Pro-Val-Ser-Leu-Ser-Tyr-Arg-Xaa₁-Pro-Xaa₂-Arg-Phe-Xaa₄-Glu-Ser-His-[linker]-Leu-Lys-Trp-Ile-Gln-Glu-Tyr-Leu-Glu-Lys-Ala-Leu-Asn-(OH)NH₂ (SEQ ID NO:72)

f65)  RHN-Xaa₃-Pro-Val-Ser-Leu-Ser-Tyr-Arg-Xaa₁-Pro-Xaa₂-Arg-Phe-Xaa₄-Glu-Ser-His-[linker]-Leu-Lys-Trp-Ile-Gln-Glu-Tyr-Leu-Glu-Lys-Ala-Leu-Asn-(OH)NH₂ (SEQ ID NO:73)

f66)  RHN-Lys-Xaa₃-Val-Ser-Leu-Ser-Tyr-Arg-Xaa₁-Pro-Xaa₂-Arg-Phe-Xaa₄-Glu-Ser-His-[linker]-Leu-Lys-Trp-Ile-Gln-Glu-Tyr-Leu-Glu-Lys-Ala-Leu-Asn-(OH)NH₂ (SEQ ID NO:74)

f67)  RHN-Lys-Pro-Xaa₃-Ser-Leu-Ser-Tyr-Arg-Xaa₁-Pro-Xaa₂-Arg-Phe-Xaa₄-Glu-Ser-His-[linker]-Leu-Lys-Trp-Ile-Gln-Glu-Tyr-Leu-Glu-Lys-Ala-Leu-Asn-(OH)NH₂ (SEQ ID NO:75)

f68)  RHN-Lys-Pro-Val-Xaa₃-Leu-Ser-Tyr-Arg-Xaa₁-Pro-Xaa₂-Arg-Phe-Xaa₄-Glu-Ser-His-[linker]-Leu-Lys-Trp-Ile-Gln-Glu-Tyr-Leu-Glu-Lys-Ala-Leu-Asn-(OH)NH₂ (SEQ ID NO:76)

f69)  RHN-Lys-Pro-Val-Ser-Xaa₃-Ser-Tyr-Arg-Xaa₁-Pro-Xaa₂-Arg-Phe-Xaa₄-Glu-Ser-His-[linker]-Leu-Lys-Trp-Ile-Gln-Glu-Tyr-Leu-Glu-Lys-Ala-Leu-Asn-(OH)NH₂ (SEQ ID NO:77)

f70)  RHN-Lys-Pro-Val-Ser-Leu-Xaa₃-Tyr-Arg-Xaa₁-Pro-Xaa₂-Arg-Phe-Xaa₄-Glu-Ser-His-[linker]-Leu-Lys-Trp-Ile-Gln-Glu-Tyr-Leu-Glu-Lys-Ala-Leu-Asn-(OH)NH₂ (SEQ ID NO:78)

f71)  RHN-Lys-Pro-Val-Ser-Leu-Ser-Xaa₃-Arg-Xaa₁-Pro-Xaa₂-Arg-Phe-Xaa₄-Glu-Ser-His-[linker]-Leu-Lys-Trp-Ile-Gln-Glu-Tyr-Leu-Glu-Lys-Ala-Leu-Asn-(OH)NH₂ (SEQ ID NO:79)

f72)  RHN-Lys-Pro-Val-Ser-Leu-Ser-Tyr-Xaa₃-Xaa₁-Pro-Xaa₂-Arg-Phe-Xaa₄-Glu-Ser-His-[linker]-Leu-Lys-Trp-Ile-Gln-Glu-Tyr-Leu-Glu-Lys-Ala-Leu-Asn-(OH)NH₂ (SEQ ID NO:80)

f73)  RHN-Lys-Pro-Val-Ser-Leu-Ser-Tyr-Arg-Xaa₁-Pro-Xaa₂-Arg-Phe-Phe-Xaa₄-Ser-His-[linker]-Leu-Lys-Trp-Ile-Gln-Glu-Tyr-Leu-Glu-Lys-Ala-Leu-Asn-(OH)NH₂ (SEQ ID NO:81)

f74)  RHN-Xaa₃-Pro-Val-Ser-Leu-Ser-Tyr-Arg-Xaa₁-Pro-Xaa₂-Arg-Phe-Phe-Xaa₄-Ser-His-[linker]-Leu-Lys-Trp-Ile-Gln-Glu-Tyr-Leu-Glu-Lys-Ala-Leu-Asn-(OH)NH₂ (SEQ ID NO:82)

f75)  RHN-Lys-Xaa₃-Val-Ser-Leu-Ser-Tyr-Arg-Xaa₁-Pro-Xaa₂-Arg-Phe-Phe-Xaa₄-Ser-His-[linker]-Leu-Lys-Trp-Ile-Gln-Glu-Tyr-Leu-Glu-Lys-Ala-Leu-Asn-(OH)NH₂ (SEQ ID NO:83)

f76)  RHN-Lys-Pro-Xaa₃-Ser-Leu-Ser-Tyr-Arg-Xaa₁-Pro-Xaa₂-Arg-Phe-Phe-Xaa₄-Ser-His-[linker]-Leu-Lys-Trp-Ile-Gln-Glu-Tyr-Leu-Glu-Lys-Ala-Leu-Asn-(OH)NH₂ (SEQ ID NO:84)

f77)  RHN-Lys-Pro-Val-Xaa₃-Leu-Ser-Tyr-Arg-Xaa₁-Pro-Xaa₂-Arg-Phe-Phe-Xaa₄-Ser-His-[linker]-Leu-Lys-Trp-Ile-Gln-Glu-Tyr-Leu-Glu-Lys-Ala-Leu-Asn-(OH)NH₂ (SEQ ID NO:85)

f78)  RHN-Lys-Pro-Val-Ser-Xaa₃-Ser-Tyr-Arg-Xaa₁-Pro-Xaa₂-Arg-Phe-Phe-Xaa₄-Ser-His-[linker]-Leu-Lys-Trp-Ile-Gln-Glu-Tyr-Leu-Glu-Lys-Ala-Leu-Asn-(OH)NH₂ (SEQ ID NO:86)

f79)  RHN-Lys-Pro-Val-Ser-Leu-Xaa₃-Tyr-Arg-Xaa₁-Pro-Xaa₂-Arg-Phe-Phe-Xaa₄-Ser-His-[linker]-Leu-Lys-Trp-Ile-Gln-Glu-Tyr-Leu-Glu-Lys-Ala-Leu-Asn-(OH)NH₁₂ (SEQ ID NO:87)

f80)  RHN-Lys-Pro-Val-Ser-Leu-Ser-Xaa₃-Arg-Xaa₁-Pro-Xaa₂-Arg-Phe-Phe-Xaa₄-Ser-His-[linker]-Leu-Lys-Trp-Ile-Gln-Glu-Tyr-Leu-Glu-Lys-Ala-Leu-Asn-(OH)NH₂ (SEQ ID NO:88)

f81)  RHN-Lys-Pro-Val-Ser-Leu-Ser-Tyr-Xaa₃-Xaa₁-Pro-Xaa₂-Arg-Phe-Phe-Xaa₄-Ser-His-[linker]1-Leu-Lys-Trp-Ile-Gln-Glu-Tyr-Leu-Glu-Lys-Ala-Leu-Asn-(OH)NH₂ (SEQ ID NO:89)

f82)  RHN-Lys-Pro-Val-Ser-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:90)

f83)  RHN-Xaa₃-Pro-Val-Ser-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:91)

f84)  RHN-Lys-Xaa₃-Val-Ser-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:92)

f85)  RHN-Lys-Pro-Xaa₃-Ser-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:93)

f86)  RHN-Lys-Pro-Val-Xaa₃-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:94)

f87)  RHN-Lys-Pro-Val-Ser-Xaa₃-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:95)

f88)  RHN-Lys-Pro-Val-Ser-Leu-Xaa₃-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:96)

f89)  RHN-Lys-Pro-Val-Ser-Leu-Ser-Xaa₃-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:97)

f90)  RHN-Lys-Pro-Val-Ser-Leu-Ser-Tyr-Xaa₃-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:98)

f91)  RHN-Lys-Pro-Val-Ser-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:99)

f92) RHN-Xaa₃-Pro-Val-Ser-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:100)

f93) RHN-Lys-Xaa₃-Val-Ser-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:101)

f94) RHN-Lys-Pro-Xaa₃-Ser-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:102)

f95) RHN-Lys-Pro-Val-Xaa₃-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:103)

f96) RHN-Lys-Pro-Val-Ser-Xaa₃-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:104)

f97) RHN-Lys-Pro-Val-Ser-Leu-Xaa₃-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:105)

f98) RHN-Lys-Pro-Val-Ser-Leu-Ser-Xaa₃-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:106)

f99) RHN-Lys-Pro-Val-Ser-Leu-Ser-Tyr-Xaa₃-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:107)

Similarly, chemokine analogs may be prepared using sequences from chemokines other than SDF-1. Such as residues 35-49, 10-49, or 55-69 of MIP-1α:

SDF-1 (1-14)-[linker]-MIP-1α (35-49)-acid or amide f100) RHN-Lys-Pro-Val-Ser-Leu-Ser-Tyr-Arg-Xaa₁-Pro-Xaa₂-Arg-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:108)

f102) RHN-Xaa₃-Pro-Val-Ser-Leu-Ser-Tyr-Arg-Xaa₁-Pro-Xaa₂-Arg-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:109)

f103) RHN-Lys-Xaa₃-Val-Ser-Leu-Ser-Tyr-Arg-Xaa₁-Pro-Xaa₂-Arg-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:110)

f104) RHN-Lys-Pro-Xaa₃-Ser-Leu-Ser-Tyr-Arg-Xaa₁-Pro-Xaa₂-Arg-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:111)

f105) RHN-Lys-Pro-Val-Xaa₃-Leu-Ser-Tyr-Arg-Xaa₁-Pro-Xaa₂-Arg-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:112)

f106) RHN-Lys-Pro-Val-Ser-Xaa₃-Ser-Tyr-Arg-Xaa₁-Pro-Xaa₂-Arg-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:113)

f107) RHN-Lys-Pro-Val-Ser-Leu-Xaa₃-Tyr-Arg-Xaa₁-Pro-Xaa₂-Arg-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:114)

f108) RHN-Lys-Pro-Val-Ser-Leu-Ser-Xaa₃-Arg-Xaa₁-Pro-Xaa₂-Arg-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:115)

f109) RHN-Lys-Pro-Val-Ser-Leu-Ser-Tyr-Xaa₃-Xaa₁-Pro-Xaa₂-Arg-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:116)

f110) RHN-Lys-Pro-Val-Ser-Leu-Ser-Tyr-Arg-Xaa₁-Pro-Xaa₂-Xaa₄-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:117)

f111) RHN-Xaa₃-Pro-Val-Ser-Leu-Ser-Tyr-Arg-Xaa₁-Pro-Xaa₂-Xaa₄-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:118)

f112) RHN-Lys-Xaa₃-Val-Ser-Leu-Ser-Tyr-Arg-Xaa₁-Pro-Xaa₂-Xaa₄-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:119)

f113) RHN-Lys-Pro-Xaa₃-Ser-Leu-Ser-Tyr-Arg-Xaa₁-Pro-Xaa₂-Xaa₄-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:120)

f114) RHN-Lys-Pro-Val-Xaa₃-Leu-Ser-Tyr-Arg-Xaa₁-Pro-Xaa₂-Xaa₄-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:121)

f115) RHN-Lys-Pro-Val-Ser-Xaa₃-Ser-Tyr-Arg-Xaa₁-Pro-Xaa₂-Xaa₄-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:122)

f116) RHN-Lys-Pro-Val-Ser-Leu-Xaa₃-Tyr-Arg-Xaa₁-Pro-Xaa₂-Xaa₄-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:123)

f117) RHN-Lys-Pro-Val-Ser-Leu-Ser-Xaa₃-Arg-Xaa₁-Pro-Xaa₂-Xaa₄-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:124)

f118) RHN-Lys-Pro-Val-Ser-Leu-Ser-Tyr-Xaa₃-Xaa₁-Pro-Xaa₂-Xaa₄-Phe-Phe-[linker]-Ser-Lys-Pro-Gly-Val-Ile-Phe-Leu-Thr-Lys-Arg-Ser-Arg-Gln-Val-(OH)NH₂ (SEQ ID NO:125)

f119) RHN-Lys-Pro-Val-Ser-Leu-Ser-Tyr-Arg-Xaa₁-Pro-Xaa₂-Arg-Xaa₄-Phe-[linker]-Ser-Lys-Pro-Gly-Val-Ile-Phe-Leu-Thr-Lys-Arg-Ser-Arg-Gln-Val-(OH)NH₂ (SEQ ID NO:126)

f120) RHN-Xaa₃-Pro-Val-Ser-Leu-Ser-Tyr-Arg-Xaa₁-Pro-Xaa₂-Arg-Xaa₄-Phe-[linker]-Ser-Lys-Pro-Gly-Val-Ile-Phe-Leu-Thr-Lys-Arg-Ser-Arg-Gln-Val-(OH)NH₂ (SEQ ID NO:127)

(121) RHN-Lys-Xaa₃-Val-Ser-Leu-Ser-Tyr-Arg-Xaa₁-Pro-Xaa₂-Arg-Xaa₄-Phe-[linker]-Ser-Lys-Pro-Gly-Val-Ile-Phe-Leu-Thr-Lys-Arg-Ser-Arg-Gln-Val-(OH)NH₂ (SEQ ID NO:128)

f122) RHN-Lys-Pro-Xaa₃-Ser-Leu-Ser-Tyr-Arg-Xaa₁-Pro-Xaa₂-Arg-Xaa₄-Phe-[linker]-Ser-Lys-Pro-Gly-Val-Ile-Phe-Leu-Thr-Lys-Arg-Ser-Arg-Gln-Val-(OH)NH₂ (SEQ ID NO:129)

f123) RHN-Lys-Pro-Val-Xaa₃-Leu-Ser-Tyr-Arg-Xaa₁-Pro-Xaa₂-Arg-Xaa₄-Phe-[linker]-Ser-Lys-Pro-Gly-Val-Ile-Phe-Leu-Thr-Lys-Arg-Ser-Arg-Gln-Val-(OH)NH₂ (SEQ ID NO:130)

f124) RHN-Lys-Pro-Val-Ser-Xaa$_3$-Ser-Tyr-Arg-Xaa$_1$-Pro-Xaa$_2$-Arg-Xaa$_4$-Phe-[linker]-Ser-Lys-Pro-Gly-Val-Ile-Phe-Leu-Thr-Lys-Arg-Ser-Arg-Gln-Val-(OH)NH$_2$ (SEQ ID NO:131)

f125) RHN-Lys-Pro-Val-Ser-Leu-Xaa$_3$-Tyr-Arg-Xaa$_1$-Pro-Xaa$_2$-Arg-Xaa$_4$-Phe-[linker]-Ser-Lys-Pro-Gly-Val-Ile-Phe-Leu-Thr-Lys-Arg-Ser-Arg-Gln-Val-(OH)NH$_2$ (SEQ ID NO:132)

f126) RHN-Lys-Pro-Val-Ser-Leu-Ser-Xaa$_3$-Arg-Xaa$_1$-Pro-Xaa$_2$-Arg-Xaa$_4$-Phe-[linker]-Ser-Lys-Pro-Gly-Val-Ile-Phe-Leu-Thr-Lys-Arg-Ser-Arg-Gln-Val-(OH)NH$_2$ (SEQ ID NO:133)

f127) RHN-Lys-Pro-Val-Ser-Leu-Ser-Tyr-Xaa$_3$-Xaa$_1$-Pro-Xaa$_2$-Arg-Xaa$_4$-Phe-[linker]-Ser-Lys-Pro-Gly-Val-Ile-Phe-Leu-Thr-Lys-Arg-Ser-Arg-Gln-Val-(OH)NH$_2$ (SEQ ID NO:134)

f128) RHN-Lys-Pro-Val-Ser-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:135)

f129) RHN-Xaa$_3$-Pro-Val-Ser-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:136)

f130) RHN-Lys-Xaa$_3$-Val-Ser-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:137)

f131) RHN-Lys-Pro-Xaa$_3$-Ser-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:138)

f132) RHN-Lys-Pro-Val-Xaa$_3$-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:139)

f133) RHN-Lys-Pro-Val-Ser-Xaa$_3$-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:140)

f134) RHN-Lys-Pro-Val-Ser-Leu-Xaa$_3$-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:141)

f135) RHN-Lys-Pro-Val-Ser-Leu-Ser-Xaa$_3$-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:142)

f136) RHN-Lys-Pro-Val-Ser-Leu-Ser-Tyr-Xaa$_3$-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:143)

SDF-1 (1-14)-[linker]-MIP-1α (55-69)-acid or amide f137) RHN-Lys-Pro-Val-Ser-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:144)

f138) RHN-Xaa$_3$-Pro-Val-Ser-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:145)

f139) RHN-Lys-Xaa$_3$-Val-Ser-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:146)

f140) RHN-Lys-Pro-Xaa$_3$-Ser-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:147)

f141) RHN-Lys-Pro-Val-Xaa$_3$-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:148)

f142) RHN-Lys-Pro-Val-Ser-Xaa$_3$-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:149)

f143) RHN-Lys-Pro-Val-Ser-Leu-Xaa$_3$-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:150)

f144) RHN-Lys-Pro-Val-Ser-Leu-Ser-Xaa$_3$-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:151)

f145) RHN-Lys-Pro-Val-Ser-Leu-Ser-Tyr-Xaa$_3$-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:152)

f146) RHN-Lys-Pro-Val-Ser-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:153)

f147) RHN-Xaa$_3$-Pro-Val-Ser-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:154)

f148) RHN-Lys-Xaa$_3$-Val-Ser-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:155)

f149) RHN-Lys-Pro-Xaa$_3$-Ser-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:156)

f150) RHN-Lys-Pro-Val-Xaa$_3$-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:157)

f151) RHN-Lys-Pro-Val-Ser-Xaa$_3$-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:158)

f152) RHN-Lys-Pro-Val-Ser-Leu-Xaa$_3$-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:159)

f153) RHN-Lys-Pro-Val-Ser-Leu-Ser-Xaa$_3$-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:160)

f154) RHN-Lys-Pro-Val-Ser-Leu-Ser-Tyr-Xaa$_3$-Xaa$_1$-Pro-Xaa$_2$-Xaa$_4$-Phe-Phe-[linker]-Leu-Lys-Trp-Ile-Gln-Glu-Tyr-Leu-Glu-Lys-Ala-Leu-Asn-(OH)NH$_2$ (SEQ ID NO:161)

f155) RHN-Lys-Pro-Val-Ser-Leu-Ser-Tyr-Arg-Xaa$_1$-Pro-Xaa$_2$-Arg-Xaa$_4$-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:162)

f156) RHN-Xaa₃-Pro-Val-Ser-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:163)

f157) RHN-Lys-Xaa₃-Val-Ser-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:164)

f158) RHN-Lys-Pro-Xaa₃-Ser-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:165)

f159) RHN-Lys-Pro-Val-Xaa₃-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:166)

f160) RHN-Lys-Pro-Val-Ser-Xaa₃-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:167)

f161) RHN-Lys-Pro-Val-Ser-Leu-Xaa₃-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:168)

f162) RHN-Lys-Pro-Val-Ser-Leu-Ser-Xaa₃-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:169)

f163) RHN-Lys-Pro-Val-Ser-Leu-Ser-Tyr-Xaa₃-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:170)

f164) RHN-Lys-Pro-Val-Ser-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:171)

f165) RHN-Xaa₃-Pro-Val-Ser-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:172)

f166) RHN-Lys-Xaa₃-Val-Ser-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:173)

f167) RHN-Lys-Pro-Xaa₃-Ser-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:174)

f168) RHN-Lys-Pro-Val-Xaa₃-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:175)

f169) RHN-Lys-Pro-Val-Ser-Xaa₃-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:176)

f170) RHN-Lys-Pro-Val-Ser-Leu-Xaa₃-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:177)

f171) RHN-Lys-Pro-Val-Ser-Leu-Ser-Xaa₃-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:178).

f172) RHN-Lys-Pro-Val-Ser-Leu-Ser-Tyr-Xaa₃-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:179)

SDF-1 (1-17)-[linker]-MIP-1α (35-49)-acid or amide f173) RHN-Lys-Pro-Val-Ser-Leu-Ser-Tyr-Arg-Xaa₁-Pro-Xaa₂-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:180)

f174) RHN-Xaa₃-Pro-Val-Ser-Leu-Ser-Tyr-Arg-Xaa₁-Pro-Xaa₂-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:181)

f175) RHN-Lys-Xaa₃-Val-Ser-Leu-Ser-Tyr-Arg-Xaa₁-Pro-Xaa₂-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:182)

f176) RHN-Lys-Pro-Xaa₃-Ser-Leu-Ser-Tyr-Arg-Xaa₁-Pro-Xaa₂-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:183)

f177) RHN-Lys-Pro-Val-Xaa₃-Leu-Ser-Tyr-Arg-Xaa₁-Pro-Xaa₂-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:184)

f178) RHN-Lys-Pro-Val-Ser-Xaa₃-Ser-Tyr-Arg-Xaa₁-Pro-Xaa₂-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:185)

f179) RHN-Lys-Pro-Val-Ser-Leu-Xaa₃-Tyr-Arg-Xaa₁-Pro-Xaa₂-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:186)

f180) RHN-Lys-Pro-Val-Ser-Leu-Ser-Xaa₃-Arg-Xaa₁-Pro-Xaa₂-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:187)

f181) RHN-Lys-Pro-Val-Ser-Leu-Ser-Tyr-Xaa₃-Xaa₁-Pro-Xaa₂-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:188)

f182) RHN-Lys-Pro-Val-Ser-Leu-Ser-Tyr-Arg-Xaa₁-Pro-Xaa₂-Xaa₄-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:189)

f183) RHN-Xaa₃-Pro-Val-Ser-Leu-Ser-Tyr-Arg-Xaa₁-Pro-Xaa₂-Xaa₄-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:190)

f184) RHN-Lys-Xaa₃-Val-Ser-Leu-Ser-Tyr-Arg-Xaa₁-Pro-Xaa₂-Xaa₄-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:191)

f185) RHN-Lys-Pro-Xaa₃-Ser-Leu-Ser-Tyr-Arg-Xaa₁-Pro-Xaa₂-Xaa₄-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:192)

f186) RHN-Lys-Pro-Val-Xaa₃-Leu-Ser-Tyr-Arg-Xaa₁-Pro-Xaa₂-Xaa₄-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:193)

f187) RHN-Lys-Pro-Val-Ser-Xaa₃-Ser-Tyr-Arg-Xaa₁-Pro-Xaa₂-Xaa₄-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:194)

f188) RHN-Lys-Pro-Val-Ser-Leu-Xaa₃-Tyr-Arg-Xaa₁-Pro-Xaa₂-Xaa₄-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:195)

f189) RHN-Lys-Pro-Val-Ser-Leu-Ser-Xaa₃-Arg-Xaa₁-Pro-Xaa₂-Xaa₄-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:196)

f190) RHN-Lys-Pro-Val-Ser-Leu-Ser-Tyr-Xaa₃-Xaa₁-Pro-Xaa₂-Xaa₄-Phe-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:197)

f191) RHN-Lys-Pro-Val-Ser-Leu-Ser-Tyr-Arg-Xaa₁-Xaa₂-Arg-Xaa₄-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:198)

f192) RHN-Xaa₃-Pro-Val-Ser-Leu-Ser-Tyr-Arg-Xaa₁-Pro-Xaa₂-Arg-Xaa₄-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:199)

f193) RHN-Lys-Xaa₃-Val-Ser-Leu-Ser-Tyr-Arg-Xaa₁-Pro-Xaa₂-Arg-Xaa₄-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:200)

f194) RHN-Lys-Pro-Xaa₃-Ser-Leu-Ser-Tyr-Arg-Xaa₁-Pro-Xaa₂-Arg-Xaa₄-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:201)

f195) RHN-Lys-Pro-Val-Xaa₃-Leu-Ser-Tyr-Arg-Xaa₁-Pro-Xaa₂-Arg-Xaa₄-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:202)

f196) RHN-Lys-Pro-Val-Ser-Xaa₃-Ser-Tyr-Arg-Xaa₁-Pro-Xaa₂-Arg-Xaa₄-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:203)

f197) RHN-Lys-Pro-Val-Ser-Leu-Xaa₃-Tyr-Arg-Xaa₁-Pro-Xaa₂-Arg-Xaa₄-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:204)

f198) RHN-Lys-Pro-Val-Ser-Leu-Ser-Xaa₃-Xaa₁-Pro-Xaa₂-Arg-Xaa₄-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:205)

f199) RHN-Lys-Pro-Val-Ser-Leu-Ser-Tyr-Xaa₃-Xaa₁-Pro-Xaa₂-Arg-Xaa₄-Phe-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:206)

f200) RHN-Lys-Pro-Val-Ser-Leu-Ser-Tyr-Arg-Xaa₁-Xaa₂-Arg-Phe-Xaa₄-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:207)

f201) RHN-Xaa₃-Pro-Val-Ser-Leu-Ser-Tyr-Arg-Xaa₁-Xaa₂-Arg-Phe-Xaa₄-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:208)

f202) RHN-Lys-Xaa₃-Val-Ser-Leu-Ser-Tyr-Arg-Xaa₁-Pro-Xaa₂-Arg-Phe-Xaa₄-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:209)

f203) RHN-Lys-Pro-Xaa₃-Ser-Leu-Ser-Tyr-Arg-Xaa₁-Pro-Xaa₂-Arg-Phe-Xaa₄-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:210)

f204) RHN-Lys-Pro-Val-Xaa₃-Leu-Ser-Tyr-Arg-Xaa₁-Pro-Xaa₂-Arg-Phe-Xaa₄-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:211)

f205) RHN-Lys-Pro-Val-Ser-Xaa₃-Ser-Tyr-Arg-Xaa₁-Pro-Xaa₂-Arg-Phe-Xaa₄-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:212)

f206) RHN-Lys-Pro-Val-Ser-Leu-Xaa₃-Tyr-Arg-Xaa₁-Pro-Xaa₂-Arg-Phe-Xaa₄-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:213)

f207) RHN-Lys-Pro-Val-Ser-Leu-Ser-Xaa₃-Arg-Xaa₁-Pro-Xaa₂-Arg-Phe-Xaa₄-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:214)

f208) RHN-Lys-Pro-Val-Ser-Leu-Ser-Tyr-Xaa₃-Xaa₁-Pro-Xaa₂-Arg-Phe-Xaa₄-Glu-Ser-His-[linker]-Ser-Lys-Pro-Gly-Val-Ile-Phe-Leu-Thr-Lys-Arg-Ser-Arg-Gln-Val-(OH)NH₂ (SEQ ID NO:215)

f209) RHN-Lys-Pro-Val-Ser-Leu-Ser-Tyr-Arg-Xaa₁-Pro-Xaa₂-Arg-Phe-Phe-Xaa₄-Ser-His-[linker]-Ser-Lys-Pro-Gly-Val-Ile-Phe-Leu-Thr-Lys-Arg-Ser-Arg-Gln-Val-(OH)NH₂ (SEQ ID NO:216)

f210) RHN-Xaa₃-Pro-Val-Ser-Leu-Ser-Tyr-Arg-Xaa₁-Pro-Xaa₂-Arg-Phe-Phe-Xaa₄-Ser-His-[linker]-Ser-Lys-Pro-Gly-Val-Ile-Phe-Leu-Thr-Lys-Arg-Ser-Arg-Gln-Val-(OH)NH₂ (SEQ ID NO:217)

f211) RHN-Lys-Xaa₃-Val-Ser-Leu-Ser-Tyr-Arg-Xaa₁-Pro-Xaa₂-Arg-Phe-Phe-Xaa₄-Ser-His-[linker]-Ser-Lys-Pro-Gly-Val-Ile-Phe-Leu-Thr-Lys-Arg-Ser-Arg-Gln-Val-(OH)NH₂ (SEQ ID NO:218)

f212) RHN-Lys-Pro-Xaa₃-Ser-Leu-Ser-Tyr-Arg-Xaa₁-Pro-Xaa₂-Arg-Phe-Phe-Xaa₄-Ser-His-[linker]-Ser-Lys-Pro-Gly-Val-Ile-Phe-Leu-Thr-Lys-Arg-Ser-Arg-Gln-Val-(OH)NH₂ (SEQ ID NO:219)

f213) RHN-Lys-Pro-Val-Xaa₃-Leu-Ser-Tyr-Arg-Xaa₁-Pro-Xaa₂-Arg-Phe-Phe-Xaa₄-Ser-His-[linker]-Ser-Lys-Pro-Gly-Val-Ile-Phe-Leu-Thr-Lys-Arg-Ser-Arg-Gln-Val-(OH)NH₂ (SEQ ID NO:220)

f214) RHN-Lys-Pro-Val-Ser-Xaa₃-Ser-Tyr-Arg-Xaa₁-Pro-Xaa₂-Arg-Phe-Phe-Xaa₄-Ser-His-[linker]-Ser-Lys-Pro-Gly-Val-Ile-Phe-Leu-Thr-Lys-Arg-Ser-Arg-Gln-Val-(OH)NH₂ (SEQ ID NO:221)

f215) RHN-Lys-Pro-Val-Ser-Leu-Xaa₃-Tyr-Arg-Xaa₁-Pro-Xaa₂-Arg-Phe-Phe-Xaa₄-Ser-His-[linker]-Ser-Lys-Pro-Gly-Val-Ile-Phe-Leu-Thr-Lys-Arg-Ser-Arg-Gln-Val-(OH)NH₂ (SEQ ID NO:222)

1216) RHN-Lys-Pro-Val-Ser-Leu-Ser-Xaa₃-Arg-Xaa₁-Pro-Xaa₂-Arg-Phe-Phe-Xaa₄ s-Ser-His-[linker]-Ser-Lys-Pro-Gly-Val-Ile-Phe-Leu-Thr-Lys-Arg-Ser-Arg-Gln-Val-(OH)NH₂ (SEQ ID NO:223)

f217) RHN-Lys-Pro-Val-Ser-Leu-Ser-Tyr-Xaa₃-Xaa₁-Pro-Xaa₂-Arg-Phe-Phe-Xaa₄-Ser-His-[linker]-Ser-Lys-Pro-Gly-Val-Ile-Phe-Leu-Thr-Lys-Arg-Ser-Arg-Gln-Val-(OH)NH₂ (SEQ ID NO:224)

f218) RHN-Lys-Pro-Val-Ser-Leu-Ser-Tyr-Arg-Xaa₁-Pro-Xaa₂-Arg-Phe-Phe-Glu-Xaa₄-His-[linker]-Ser-Lys-Pro-Gly-Val-Ile-Phe-Leu-Thr-Lys-Arg-Ser-Arg-Gln-Val-(OH)NH₂ (SEQ ID NO:225)

f219) RHN-Xaa₃-Pro-Val-Ser-Leu-Ser-Tyr-Arg-Xaa₁-Pro-Xaa₂-Arg-Phe-Phe-Glu-Xaa₄-His-[linker]-Ser-Lys-Pro-Gly-Val-Ile-Phe-Leu-Thr-Lys-Arg-Ser-Arg-Gln-Val-(OH)NH₂ (SEQ ID NO:226)

f220) RHN-Lys-Xaa$_3$-Val-Ser-Leu-Ser-Tyr-Arg-Xaa$_1$-Pro-Xaa$_2$-Arg-Phe-Phe-Glu-Xaa$_4$-His-[linker]-Ser-Lys-Pro-Gly-Val-Ile-Phe-Leu-Thr-Lys-Arg-Ser-Arg-Gln-Val-(OH)NH$_2$ (SEQ ID NO:227)

f221) RHN-Lys-Pro-Xaa$_3$-Ser-Leu-Ser-Tyr-Arg-Xaa$_1$-Pro-Xaa$_2$-Arg-Phe-Phe-Glu-Xaa$_4$-His-[linker]-Ser-Lys-Pro-Gly-Val-Ile-Phe-Leu-Thr-Lys-Arg-Ser-Arg-Gln-Val-(OH)NH$_2$ (SEQ ID NO:228)

f222) RHN-Lys-Pro-Val-Xaa$_3$-Leu-Ser-Tyr-Arg-Xaa$_1$-Pro-Xaa$_2$-Arg-Phe-Phe-Glu-Xaa$_4$-His-[linker]-Ser-Lys-Pro-Gly-Val-Ile-Phe-Leu-Thr-Lys-Arg-Ser-Arg-Gln-Val-(OH)NH$_2$ (SEQ ID NO:229)

f223) RHN-Lys-Pro-Val-Ser-Xaa$_3$-Ser-Tyr-Arg-Xaa$_1$-Pro-Xaa$_2$-Arg-Phe-Phe-Glu-Xaa$_4$-His-[linker]-Ser-Lys-Pro-Gly-Val-Ile-Phe-Leu-Thr-Lys-Arg-Ser-Arg-Gln-Val-(OH)NH$_2$ (SEQ ID NO:230)

f224) RHN-Lys-Pro-Val-Ser-Leu-Xaa$_3$-Tyr-Arg-Xaa$_1$-Pro-Xaa$_2$-Arg-Phe-Phe-Glu-Xaa$_4$-His-[linker]-Ser-Lys-Pro-Gly-Val-Ile-Phe-Leu-Thr-Lys-Arg-Ser-Arg-Gln-Val-(OH)NH$_2$ (SEQ ID NO:231)

f225) RHN-Lys-Pro-Val-Ser-Leu-Ser-Xaa$_3$-Arg-Xaa$_1$-Pro-Xaa$_2$-Arg-Phe-Phe-Glu-Xaa$_4$-His-[linker]-Ser-Lys-Pro-Gly-Val-Ile-Phe-Leu-Thr-Lys-Arg-Ser-Arg-Gln-Val-(OH)NH$_2$ (SEQ ID NO:232)

f226) RHN-Lys-Pro-Val-Ser-Leu-Ser-Tyr-Xaa$_3$-Xaa$_1$-Pro-Xaa$_2$-Arg-Phe-Phe-Glu-Xaa$_4$-His-[linker]-Ser-Lys-Pro-Gly-Val-Ile-Phe-Leu-Thr-Lys-Arg-Ser-Arg-Gln-Val-(OH)NH$_2$ (SEQ ID NO:233)

f227) RHN-Lys-Pro-Val-Ser-Leu-Ser-Tyr-Arg-Xaa$_1$-Pro-Xaa$_2$-Arg-Phe-Phe-Glu-Ser-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:234)

f228) RHN-Xaa$_3$-Pro-Val-Ser-Leu-Ser-Tyr-Arg-Xaa$_1$-Pro-Xaa$_2$-Arg-Phe-Phe-Glu-Ser-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:235)

f229) RHN-Lys-Xaa$_3$-Val-Ser-Leu-Ser-Tyr-Arg-Xaa$_1$-Pro-Xaa$_2$-Arg-Phe-Phe-Glu-Ser-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:236)

f230) RHN-Lys-Pro-Xaa$_3$-Ser-Leu-Ser-Tyr-Arg-Xaa$_1$-Pro-Xaa$_2$-Arg-Phe-Phe-Glu-Ser-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:237)

f231) RHN-Lys-Pro-Val-Xaa$_3$-Leu-Ser-Tyr-Arg-Xaa$_1$-Pro-Xaa$_2$-Arg-Phe-Phe-Glu-Ser-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:238)

f232) RHN-Lys-Pro-Val-Ser-Xaa$_3$-Ser-Tyr-Arg-Xaa$_1$-Pro-Xaa$_2$-Arg-Phe-Phe-Glu-Ser-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:239)

f233) RHN-Lys-Pro-Val-Ser-Leu-Xaa$_3$-Tyr-Arg-Xaa$_1$-Pro-Xaa$_2$-Arg-Phe-Phe-Glu-Ser-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:240)

f234) RHN-Lys-Pro-Val-Ser-Leu-Ser-Xaa$_3$-Arg-Xaa$_1$-Pro-Xaa$_2$-Arg-Phe-Phe-Glu-Ser-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:241)

f235) RHN-Lys-Pro-Val-Ser-Leu-Ser-Tyr-Xaa$_3$-Xaa$_1$-Pro-Xaa$_2$-Arg-Phe-Phe-Glu-Ser-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:242)

SDF-1 (1-17)-[linker]-MIP-1α (55-69)-acid or amide f236) RHN-Lys-Pro-Val-Ser-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:243)

f237) RHN-Xaa$_3$-Pro-Val-Ser-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:244)

f238) RHN-Lys-Xaa$_3$-Val-Ser-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:245)

f239) RHN-Lys-Pro-Xaa$_3$-Ser-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:246)

f240) RHN-Lys-Pro-Val-Xaa$_3$-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:247)

f241) RHN-Lys-Pro-Val-Ser-Xaa$_3$-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:248)

f242) RHN-Lys-Pro-Val-Ser-Leu-Xaa$_3$-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:249)

f243) RHN-Lys-Pro-Val-Ser-Leu-Ser-Xaa$_3$-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:250)

f244) RHN-Lys-Pro-Val-Ser-Leu-Ser-Tyr-Xaa$_3$-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:251)

f245) RHN-Lys-Pro-Val-Ser-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:252)

f246) RHN-Xaa$_3$-Pro-Val-Ser-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:253)

f247) RHN-Lys-Xaa$_3$-Val-Ser-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:254)

f248) RHN-Lys-Pro-Xaa$_3$-Ser-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:255)

f249) RHN-Lys-Pro-Val-Xaa$_3$-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:256)

f250) RHN-Lys-Pro-Val-Ser-Xaa$_3$-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:257)

f251) RHN-Lys-Pro-Val-Ser-Leu-Xaa$_3$-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:258)

f252) RHN-Lys-Pro-Val-Ser-Leu-Ser-Xaa$_3$-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:259)

f253) RHN-Lys-Pro-Val-Ser-Leu-Ser-Tyr-Xaa$_3$-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:260)

f254) RHN-Lys-Pro-Val-Ser-Leu-Ser-Tyr-Arg-Xaa$_1$-Pro-Xaa$_2$-Arg-Xaa$_4$-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:261)

f255) RHN-Xaa$_3$-Pro-Val-Ser-Leu-Ser-Tyr-Arg-Xaa$_1$-Pro-Xaa$_2$-Arg-Xaa$_4$-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:262)

f256) RHN-Lys-Xaa$_3$-Val-Ser-Leu-Ser-Tyr-Arg-Xaa$_1$-Pro-Xaa$_2$-Arg-Xaa$_4$-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:263)

f257) RHN-Lys-Pro-Xaa$_3$-Ser-Leu-Ser-Tyr-Arg-Xaa$_1$-Pro-Xaa$_2$-Arg-Xaa$_4$-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:264)

f258) RHN-Lys-Pro-Val-Xaa$_3$-Leu-Ser-Tyr-Arg-Xaa$_1$-Pro-Xaa$_2$-Arg-Xaa$_4$-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:265)

f259) RHN-Lys-Pro-Val-Ser-Xaa$_3$-Ser-Tyr-Arg-Xaa$_1$-Pro-Xaa$_2$-Arg-Xaa$_4$-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:266)

f260) RHN-Lys-Pro-Val-Ser-Leu-Xaa$_3$-Tyr-Arg-Xaa$_1$-Pro-Xaa$_2$-Arg-Xaa$_4$-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:267)

f261) RHN-Lys-Pro-Val-Ser-Leu-Ser-Xaa$_3$-Arg-Xaa$_1$-Pro-Xaa$_2$-Arg-Xaa$_4$-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:268)

f262) RHN-Lys-Pro-Val-Ser-Leu-Ser-Tyr-Xaa$_3$-Xaa$_1$-Pro-Xaa$_2$-Arg-Xaa$_4$-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:269)

f263) RHN-Lys-Pro-Val-Ser-Leu-Ser-Tyr-Arg-Xaa$_1$-Pro-Xaa$_2$-Arg-Phe-Xaa$_4$-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:270)

f264) RHN-Xaa$_3$-Pro-Val-Ser-Leu-Ser-Tyr-Arg-Xaa$_1$-Pro-Xaa$_2$-Arg-Phe-Xaa$_4$-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:271)

f265) RHN-Lys-Xaa$_3$-Val-Ser-Leu-Ser-Tyr-Arg-Xaa$_1$-Pro-Xaa$_2$-Arg-Phe-Xaa$_4$-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:272)

f266) RHN-Lys-Pro-Xaa$_3$-Ser-Leu-Ser-Tyr-Arg-Xaa$_1$-Pro-Xaa$_2$-Arg-Phe-Xaa$_4$-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:273)

f267) RHN-Lys-Pro-Val-Xaa$_3$-Leu-Ser-Tyr-Arg-Xaa$_1$-Pro-Xaa$_2$-Arg-Phe-Xaa$_4$-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:274)

f268) RHN-Lys-Pro-Val-Ser-Xaa$_3$-Ser-Tyr-Arg-Xaa$_1$-Pro-Xaa$_2$-Arg-Phe-Xaa$_4$-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:275)

f269) RHN-Lys-Pro-Val-Ser-Leu-Xaa$_3$-Tyr-Arg-Xaa$_1$-Pro-Xaa$_2$-Arg-Phe-Xaa$_4$-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:276)

f270) RHN-Lys-Pro-Val-Ser-Leu-Ser-Xaa$_3$-Arg-Xaa$_1$-Pro-Xaa$_2$-Arg-Phe-Xaa$_4$-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:277)

f271) RHN-Lys-Pro-Val-Ser-Leu-Ser-Tyr-Xaa$_3$-Xaa$_1$-Pro-Xaa$_2$-Arg-Phe-Xaa$_4$-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:278)

f272) RHN-Lys-Pro-Val-Ser-Leu-Ser-Tyr-Arg-Xaa$_1$-Pro-Xaa$_2$-Arg-Phe-Phe-Xaa$_4$ s-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:279)

f273) RHN-Xaa$_3$-Pro-Val-Ser-Leu-Ser-Tyr-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:280)

f274) RHN-Lys-Xaa$_3$-Val-Ser-Leu-Ser-Tyr-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:281)

f275) RHN-Lys-Pro-Xaa$_3$-Ser-Leu-Ser-Tyr-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:282)

f276) RHN-Lys-Pro-Val-Xaa$_3$-Leu-Ser-Tyr-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:283)

f277) RHN-Lys-Pro-Val-Ser-Xaa$_3$-Ser-Tyr-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:284)

f278) RHN-Lys-Pro-Val-Ser-Leu-Xaa$_3$-Tyr-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:285)

f279) RHN-Lys-Pro-Val-Ser-Leu-Ser-Xaa$_3$-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:286)

f280) RHN-Lys-Pro-Val-Ser-Leu-Ser-Tyr-Xaa$_3$-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:287)

f281) RHN-Lys-Pro-Val-Ser-Leu-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:288)

f282) RHN-Xaa$_3$-Pro-Val-Ser-Leu-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:289)

f283) RHN-Lys-Xaa$_3$-Val-Ser-Leu-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:290)

f284) RHN-Lys-Pro-Xaa$_3$-Ser-Leu-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:291)

f285) RHN-Lys-Pro-Val-Xaa$_3$-Leu-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:292)

f286) RHN-Lys-Pro-Val-Ser-Xaa$_3$-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:293)

f287) RHN-Lys-Pro-Val-Ser-Leu-Xaa$_3$-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:294)

f288) RHN-Lys-Pro-Val-Ser-Leu-Ser-Xaa$_3$-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:295)

f289) RHN-Lys-Pro-Val-Ser-Leu-Ser-Tyr-Xaa$_3$-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:296)

f290) RHN-Lys-Pro-Val-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:297)

f291) RHN-Xaa$_3$-Pro-Val-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:298)

f292) RHN-Lys-Xaa$_3$-Val-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:299)

f293) RHN-Lys-Pro-Xaa$_3$-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:300)

f294) RHN-Lys-Pro-Val-Xaa$_3$-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:301)

f295) RHN-Lys-Pro-Val-Ser-Xaa$_3$-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:302)

f296) RHN-Lys-Pro-Val-Ser-Leu-Xaa$_3$-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:303)

f297) RHN-Lys-Pro-Val-Ser-Leu-Ser-Xaa$_3$-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:304)

f298) RHN-Lys-Pro-Val-Ser-Leu-Ser-Tyr-Xaa$_3$-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:305)

Preferred embodiments of cyclic SDF-1 analogs of the present invention corresponding to a portion the N-terminal region joined with a linker to a cyclic portion of the C-terminal region of SDF-1 having the following structures:
SDF-1 (1-14)-[linker]-SDF-1 (55-67)-cyclic(Glu60-Lys64) acid or amide:

f299) RHN-Lys-Pro-Val-Ser-Leu-Ser-Tyr-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-(OH)NH$_2$ (SEQ ID NO:306)

f300) RHN-Xaa$_3$-Pro-Val-Ser-Leu-Ser-Tyr-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-(OH)NH$_2$ (SEQ ID NO:307)

f301) RHN-Lys-Xaa$_3$-Val-Ser-Leu-Ser-Tyr-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-(OH)NH$_2$ (SEQ ID NO:308)

f302) RHN-Lys-Pro-Xaa$_3$-Ser-Leu-Ser-Tyr-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-(OH)NH$_2$ (SEQ ID NO:309)

f303) RHN-Lys-Pro-Val-Xaa$_3$-Leu-Ser-Tyr-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-(OH)NH$_2$ (SEQ ID NO:310)

f304) RHN-Lys-Pro-Val-Ser-Xaa$_3$-Ser-Tyr-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-(OH)NH$_2$ (SEQ ID NO:311)

f305) RHN-Lys-Pro-Val-Ser-Leu-Xaa$_3$-Tyr-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-(OH)NH$_2$ (SEQ ID NO:312)

f306) RHN-Lys-Pro-Val-Ser-Leu-Ser-Xaa$_3$-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-(OH)NH$_2$ (SEQ ID NO:313)

f307) RHN-Lys-Pro-Val-Ser-Leu-Ser-Tyr-Xaa$_3$-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-(OH)NH$_2$ (SEQ ID NO:314)

f309) RHN-Lys-Pro-Val-Ser-Leu-Ser-Tyr-Arg-Xaa$_1$-Pro-Xaa$_2$-Xaa$_4$-Phe-Phe-[linker]-Leu-Lys-Trp-Ile-Gln-Glu-Tyr-Leu-Glu-Lys-Ala-Leu-Asn-(OH)N$_2$ (SEQ ID NO:315)

f310) RHN-Xaa$_3$-Pro-Val-Ser-Leu-Ser-Tyr-Arg-Xaa$_1$-Pro-Xaa$_2$-Xaa$_4$-Phe-Phe-[linker]-Leu-Lys-Trp-Ile-Gln-Glu-Tyr-Leu-Glu-Lys-Ala-Leu-Asn-(OH)NH$_2$ (SEQ ID NO:316)

f311) RHN-Lys-Xaa$_3$-Val-Ser-Leu-Ser-Tyr-Arg-Xaa$_1$-Pro-Xaa$_2$-Xaa$_4$-Phe-Phe-[linker]-Leu-Lys-Trp-Ile-Gln-Glu-Tyr-Leu-Glu-Lys-Ala-Leu-Asn-(OH)NH$_{12}$ (SEQ ID NO:317)

f312) RHN-Lys-Pro-Xaa$_3$-Ser-Leu-Ser-Tyr-Arg-Xaa$_1$-Pro-Xaa$_2$-Xaa$_4$-Phe-Phe-[linker]-Leu-Lys-Trp-Ile-Gln-Glu-Tyr-Leu-Glu-Lys-Ala-Leu-Asn-(OH)NH$_2$ (SEQ ID NO:318)

f313) RHN-Lys-Pro-Val-Xaa$_3$-Leu-Ser-Tyr-Arg-Xaa$_1$-Pro-Xaa$_2$-Xaa$_4$-Phe-Phe-[linker]-Leu-Lys-Trp-Ile-Gln-Glu-Tyr-Leu-Glu-Lys-Ala-Leu-Asn-(OH)NH$_2$ (SEQ ID NO:319)

f314) RHN-Lys-Pro-Val-Ser-Xaa$_3$-Ser-Tyr-Arg-Xaa$_1$-Pro-Xaa$_2$-Xaa$_4$-Phe-Phe-[linker]-Leu-Lys-Trp-Ile-Gln-Glu-Tyr-Leu-Glu-Lys-Ala-Leu-Asn-(OH)NH$_2$ (SEQ ID NO:320)

f315) RHN-Lys-Pro-Val-Ser-Leu-Xaa$_3$-Tyr-Arg-Xaa$_1$-Pro-Xaa$_2$-Xaa$_4$-Phe-Phe-[linker]-Leu-Lys-Trp-Ile-Gln-Glu-Tyr-Leu-Glu-Lys-Ala-Leu-Asn-(OH)NH$_2$ (SEQ ID NO:321)

f316) RHN-Lys-Pro-Val-Ser-Leu-Ser-Xaa₃-Arg-Xaa₁-Pro-Xaa₂-Xaa₄-Phe-Phe-[linker]-Leu-Lys-Trp-Ile-Gln-Glu-Tyr-Leu-Glu-Lys-Ala-Leu-Asn-(OH)NH₂ (SEQ ID NO:322)

f317) RHN-Lys-Pro-Val-Ser-Leu-Ser-Tyr-Xaa₃-Xaa₁-Pro-Xaa₂-Xaa₄-Phe-Phe-[linker]-Leu-Lys-Trp-Ile-Gln-Glu-Tyr-Leu-Glu-Lys-Ala-Leu-Asn-(OH)NH₂ (SEQ ID NO:323)

f318) RHN-Lys-Pro-Val-Ser-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:324)

f319) RHN-Xaa₃-Pro-Val-Ser-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:325)

f320) RHN-Lys-Xaa₃-Val-Ser-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:326)

f321) RHN-Lys-Pro-Xaa₃-Ser-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:327)

f322) RHN-Lys-Pro-Val-Xaa₃-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:328)

f323) RHN-Lys-Pro-Val-Ser-Xaa₃-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:329)

f324) RHN-Lys-Pro-Val-Ser-Leu-Xaa₃-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:330)

f325) RHN-Lys-Pro-Val-Ser-Leu-Ser-Xaa₃-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:331)

f326) RHN-Lys-Pro-Val-Ser-Leu-Ser-Tyr-Xaa₃-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:332)

f327) RHN-Lys-Pro-Val-Ser-Leu-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:333)

f328) RHN-Xaa₃-Pro-Val-Ser-Leu-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:334)

f329) RHN-Lys-Xaa₃-Val-Ser-Leu-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:335)

f330) RHN-Lys-Pro-Xaa₃-Ser-Leu-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:336)

f331) RHN-Lys-Pro-Val-Xaa₃-Leu-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:337)

f332) RHN-Lys-Pro-Val-Ser-Xaa₃-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:338)

f334) RHN-Lys-Pro-Val-Ser-Leu-Xaa₃-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:339)

f335) RHN-Lys-Pro-Val-Ser-Leu-Ser-Xaa₃-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:340)

f336) RHN-Lys-Pro-Val-Ser-Leu-Ser-Tyr-Xaa₃-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:341)

SDF-1 (1-17)-[linker]-SDF-1 (55-67)-cyclic(Glu60-Lys64) acid or amide:

f337) RHN-Lys-Pro-Val-Ser-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:342)

f338) RHN-Xaa₃-Pro-Val-Ser-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:343)

f339) RHN-Lys-Xaa₃-Val-Ser-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:344)

f340) RHN-Lys-Pro-Xaa₃-Ser-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:345)

f341) RHN-Lys-Pro-Val-Xaa₃-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:346)

f342) RHN-Lys-Pro-Val-Ser-Xaa₃-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:347)

f343) RHN-Lys-Pro-Val-Ser-Leu-Xaa₃-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:348)

f344) RHN-Lys-Pro-Val-Ser-Leu-Ser-Xaa₃-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:349)

f345) RHN-Lys-Pro-Val-Ser-Leu-Ser-Tyr-Xaa₃-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:350)

f346) RHN-Lys-Pro-Val-Ser-Leu-Ser-Tyr-Arg-Xaa₁-Pro-Xaa₂-Xaa₄-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:351)

f347) RHN-Xaa₃-Pro-Val-Ser-Leu-Ser-Tyr-Arg-Xaa₁-Pro-Xaa₂-Xaa₄-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:352)

f348) RHN-Lys-Xaa₃-Val-Ser-Leu-Ser-Tyr-Arg-Xaa₁-Pro-Xaa₂-Xaa₄-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:353)

f349) RHN-Lys-Pro-Xaa$_3$-Ser-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:354)

f350) RHN-Lys-Pro-Val-Xaa$_3$-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:355)

f351) RHN-Lys-Pro-Val-Ser-Xaa$_3$-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:356)

f352) RHN-Lys-Pro-Val-Ser-Leu-Xaa$_3$-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:357)

f353) RHN-Lys-Pro-Val-Ser-Leu-Ser-Xaa$_3$-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:358)

f354) RHN-Lys-Pro-Val-Ser-Leu-Ser-Tyr-Xaa$_3$-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:359)

f355) RHN-Lys-Pro-Val-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:360)

f356) RHN-Xaa$_3$-Pro-Val-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:361)

f357) RHN-Lys-Xaa$_3$-Val-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:362)

f358) RHN-Lys-Pro-Xaa$_3$-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:363)

f359) RHN-Lys-Pro-Val-Xaa$_3$-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:364)

f360) RHN-Lys-Pro-Val-Ser-Xaa$_3$-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:365)

f361) RHN-Lys-Pro-Val-Ser-Leu-Xaa$_3$-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:366)

f362) RHN-Lys-Pro-Val-Ser-Leu-Ser-Xaa$_3$-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:367)

f363) RHN-Lys-Pro-Val-Ser-Leu-Ser-Tyr-Xaa$_3$-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:368)

f364) RHN-Lys-Pro-Val-Ser-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:369)

f365) RHN-Xaa$_3$-Pro-Val-Ser-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:370)

f366) RHN-Lys-Xaa$_3$-Val-Ser-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:371)

f367) RHN-Lys-Pro-Xaa$_3$-Ser-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:372)

f368) RHN-Lys-Pro-Val-Xaa$_3$-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:373)

f369) RHN-Lys-Pro-Val-Ser-Xaa$_3$-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:374)

f370) RHN-Lys-Pro-Val-Ser-Leu-Xaa$_3$-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:375)

f371) RHN-Lys-Pro-Val-Ser-Leu-Ser-Xaa$_3$-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:376)

f372) RHN-Lys-Pro-Val-Ser-Leu-Ser-Tyr-Xaa$_3$-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:377)

f373) RHN-Lys-Pro-Val-Ser-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:378)

f374) RHN-Xaa$_3$-Pro-Val-Ser-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_{12}$ (SEQ ID NO:379)

f375) RHN-Lys-Xaa$_3$-Val-Ser-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:380)

f376) RHN-Lys-Pro-Xaa$_3$-Ser-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:381)

f377) RHN-Lys-Pro-Val-Xaa$_3$-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:382)

f378) RHN-Lys-Pro-Val-Ser-Xaa$_3$-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:383)

f379) RHN-Lys-Pro-Val-Ser-Leu-Xaa$_3$-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:384)

f380) RHN-Lys-Pro-Val-Ser-Leu-Ser-Xaa$_3$-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:385)

f381) RHN-Lys-Pro-Val-Ser-Leu-Ser-Tyr-Xaa₃-Xaa₁-Pro-Xaa₂-Arg-Phe-Phe-Xaa₄-Ser-His-[linker]-Leu-Lys-Trp-Ile-Gln-Glu-Tyr-Leu-Glu-Lys-Ala-Leu-Asn-(OH)NH₁₂ (SEQ ID NO:386)

f382) RHN-Lys-Pro-Val-Ser-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:387)

f383) RHN-Xaa₃-Pro-Val-Ser-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:388)

f384) RHN-Lys-Xaa₃-Val-Ser-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:389)

f385) RHN-Lys-Pro-Xaa₃-Ser-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:390)

f386) RHN-Lys-Pro-Val-Xaa₃-Leu-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:391)

f387) RHN-Lys-Pro-Val-Ser-Xaa₃-Ser-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:392)

f388) RHN-Lys-Pro-Val-Ser-Leu-Xaa₃-Tyr-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:393)

f389) RHN-Lys-Pro-Val-Ser-Leu-Ser-Xaa₃-Arg-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:394)

f390) RHN-Lys-Pro-Val-Ser-Leu-Ser-Tyr-Xaa₃-Xaa₁-Pro-Xaa₂-Arg-Phe-Phe-Glu-Xaa₄-His-[linker]-Leu-Lys-Trp-Ile-Gln-Glu-Tyr-Leu-Glu-Lys-Ala-Leu-Asn-(OH)NH₂ (SEQ ID NO:395)

f391) RHN-Lys-Pro-Val-Ser-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:396)

f392) RHN-Xaa₃-Pro-Val-Ser-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:397)

f393) RHN-Lys-Xaa₃-Val-Ser-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:398)

f394) RHN-Lys-Pro-Xaa₃-Ser-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:399)

f395) RHN-Lys-Pro-Val-Xaa₃-Leu-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:400)

f396) RHN-Lys-Pro-Val-Ser-Xaa₃-Ser-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:401)

f397) RHN-Lys-Pro-Val-Ser-Leu-Xaa₃-Tyr-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:402)

f398) RHN-Lys-Pro-Val-Ser-Leu-Ser-Xaa₃-Arg-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:403)

f399) RHN-Lys-Pro-Val-Ser-Leu-Ser-Tyr-Xaa₃-Xaa₁-Pro-Xaa₂-Arg-Phe-Phe-Glu-Ser-Xaa₄-[linker]-Leu-Lys-Trp-Ile-Gln-Glu-Tyr-Leu-Glu-Lys-Ala-Leu-Asn-(OH)NH₂ (SEQ ID NO:404)

SDF-1 (1-14)-[linker]-SDF-1 (55-67)-cyclic(Lys56-Glu60) acid or amide:

f400) RHN-Lys-Pro-Val-Ser-Leu-Ser-Tyr-Arg-Xaa₁-Pro-Xaa₂-Arg-Phe-Phe-[linker]-Leu-Lys-Trp-Ile-Gln-Glu-Tyr-Leu-Glu-Lys-Ala-Leu-Asn-(OH)NH₂ (SEQ ID NO:405)

f401) RHN-Xaa₃-Pro-Val-Ser-Leu-Ser-Tyr-Arg-Xaa₁-Pro-Xaa₂-Arg-Phe-Phe-[linker]-Leu-Lys-Trp-Ile-Gln-Glu-Tyr-Leu-Glu-Lys-Ala-Leu-Asn-(OH)NH₂ (SEQ ID NO:406)

f402) RHN-Lys-Xaa₃-Val-Ser-Leu-Ser-Tyr-Arg-Xaa₁-Pro-Xaa₂-Arg-Phe-Phe-[linker]-Leu-Lys-Trp-Ile-Gln-Glu-Tyr-Leu-Glu-Lys-Ala-Leu-Asn-(OH)NH₂ (SEQ ID NO:407)

f403) RHN-Lys-Pro-Xaa₃-Ser-Leu-Ser-Tyr-Arg-Xaa₁-Pro-Xaa₂-Arg-Phe-Phe-[linker]-Leu-Lys-Trp-Ile-Gln-Glu-Tyr-Leu-Glu-Lys-Ala-Leu-Asn-(OH)NH₂ (SEQ ID NO:408)

f404) RHN-Lys-Pro-Val-Xaa₃-Leu-Ser-Tyr-Arg-Xaa₁-Pro-Xaa₂-Arg-Phe-Phe-[linker]-Leu-Lys-Trp-Ile-Gln-Glu-Tyr-Leu-Glu-Lys-Ala-Leu-Asn-(OH)NH₂ (SEQ ID NO:409)

f405) RHN-Lys-Pro-Val-Ser-Xaa₃-Ser-Tyr-Arg-Xaa₁-Pro-Xaa₂-Arg-Phe-Phe-[linker]-Leu-Lys-Trp-Ile-Gln-Glu-Tyr-Leu-Glu-Lys-Ala-Leu-Asn-(OH)NH₂ (SEQ ID NO:410)

f406) RHN-Lys-Pro-Val-Ser-Leu-Xaa₃-Tyr-Arg-Xaa₁-Pro-Xaa₂-Arg-Phe-Phe-[linker]-Leu-Lys-Trp-Ile-Gln-Glu-Tyr-Leu-Glu-Lys-Ala-Leu-Asn-(OH)NH₂ (SEQ ID NO:411)

f407) RHN-Lys-Pro-Val-Ser-Leu-Ser-Xaa₃-Arg-Xaa₁-Pro-Xaa₂-Arg-Phe-Phe-[linker]-Leu-Lys-Trp-Ile-Gln-Glu-Tyr-Leu-Glu-Lys-Ala-Leu-Asn-(OH)NH₂ (SEQ ID NO:412)

f408) RHN-Lys-Pro-Val-Ser-Leu-Ser-Tyr-Xaa₃-Xaa₁-Pro-Xaa₂-Arg-Phe-Phe-[linker]-Leu-Lys-Trp-Ile-Gln-Glu-Tyr-Leu-Glu-Lys-Ala-Leu-Asn-(OH)NH₂ (SEQ ID NO:413)

f409) RHN-Lys-Pro-Val-Ser-Leu-Ser-Tyr-Arg-Xaa₁-Pro-Xaa₂-Xaa₄-Phe-Phe-[linker]-Leu-Lys-Trp-Ile-Gln-Glu-Tyr-Leu-Glu-Lys-Ala-Leu-Asn-(OH)NH₂ (SEQ ID NO:414)

f410) RHN-Xaa₃-Pro-Val-Ser-Leu-Ser-Tyr-Arg-Xaa₁-Pro-Xaa₂-Xaa₄-Phe-Phe-[linker]-Leu-Lys-Trp-Ile-Gln-Glu-Tyr-Leu-Glu-Lys-Ala-Leu-Asn-(OH)NH₂ (SEQ ID NO:415)

f411) RHN-Lys-Xaa₃-Val-Ser-Leu-Ser-Tyr-Arg-Xaa₁-Pro-Xaa₂-Xaa₄-Phe-Phe-[linker]-Leu-Lys-Trp-Ile-Gln-Glu-Tyr-Leu-Glu-Lys-Ala-Leu-Asn-(OH)NH₂ (SEQ ID NO:416)

f412) RHN-Lys-Pro-Xaa₃-Ser-Leu-Ser-Tyr-Arg-Xaa₁-Pro-Xaa₂-Xaa₄-Phe-Phe-[linker]-Leu-Lys-Trp-Ile-Gln-Glu-Tyr-Leu-Glu-Lys-Ala-Leu-Asn-(OH)NH₂ (SEQ ID NO:417)

f413) RHN-Lys-Pro-Val-Xaa₃-Leu-Ser-Tyr-Arg-Xaa₁-Pro-Xaa₂-Xaa₄-Phe-Phe-[linker]-Leu-Lys-Trp-Ile-Gln-Glu-4-Tyr-Leu-Glu-Lys-Ala-Leu-Asn-(OH)NH₂ (SEQ ID NO:418)

f414) RHN-Lys-Pro-Val-Ser-Xaa₃-Ser-Tyr-Arg-Xaa₁-Pro-Xaa₂-Xaa₄-Phe-Phe-[linker]-Leu-Lys-Trp-Ile-Gln-Glu-Tyr-Leu-Glu-Lys-Ala-Leu-Asn-(OH)NH₂ (SEQ ID NO:419)

f415) RHN-Lys-Pro-Val-Ser-Leu-Xaa₃-Tyr-Arg-Xaa₁-Pro-Xaa₂-Xaa₄-Phe-Phe-[linker]-Leu-Lys-Trp-Ile-Gln-Glu-Tyr-Leu-Glu-Lys-Ala-Leu-Asn-(OH)NH₂ (SEQ ID NO:420)

f416) RHN-Lys-Pro-Val-Ser-Leu-Ser-Xaa₃-Arg-Xaa₁-Pro-Xaa₂-Xaa₄-Phe-Phe-[linker]-Leu-L-Trp-Ile-Gln-Glu-Tyr-Leu-Glu-Lys-Ala-Leu-Asn-(OH)NH₂ (SEQ ID NO:421)

f417) RHN-Lys-Pro-Val-Ser-Leu-Ser-Tyr-Xaa₃-Xaa₁-Pro-Xaa₂-Xaa₄-Phe-Phe-[linker]-Leu-Lys-Trp-Ile-Gln-Glu-Tyr-Leu-Glu-Lys-Ala-Leu-Asn-(OH)NH₂ (SEQ ID NO:422)

f418) RHN-Lys-Pro-Val-Ser-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:423)

f419) RHN-Xaa₃-Pro-Val-Ser-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:424)

f420) RHN-Lys-Xaa₃-Val-Ser-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:425)

f421) RHN-Lys-Pro-Xaa₃-Ser-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:426)

f422) RHN-Lys-Pro-Val-Xaa₃-Leu-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:427)

f423) RHN-Lys-Pro-Val-Ser-Xaa₃-Ser-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:428)

f424) RHN-Lys-Pro-Val-Ser-Leu-Xaa₃-Tyr-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:429)

f425) RHN-Lys-Pro-Val-Ser-Leu-Ser-Xaa₃-Arg-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:430)

f426) RHN-Lys-Pro-Val-Ser-Leu-Ser-Tyr-Xaa₃-Xaa₁-Pro-Xaa₂-Arg-Xaa₄-Phe-[linker]-Leu-Lys-Trp-Ile-Gln-Glu-Tyr-Leu-Glu-Lys-Ala-Leu-Asn-(OH)NH₂ (SEQ ID NO:431)

f427) RHN-Lys-Pro-Val-Ser-Leu-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:432)

f428) RHN-Xaa₃-Pro-Val-Ser-Leu-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:433)

f429) RHN-Lys-Xaa₃-Val-Ser-Leu-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:434)

f430) RHN-Lys-Pro-Xaa₃-Ser-Leu-Ser-Tyr-Arg-Xaa₁-Pro-Xaa₂-Arg-Phe-Xaa₄-[linker]-Leu-L-Trp-Ile-Gln-Glu-Tyr-Leu-Glu-Lys-Ala-Leu-Asn-(OH)NH₂ (SEQ ID NO:435)

f431a) RHN-Lys-Pro-Val-Xaa₃-Leu-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:436)

f432a) RHN-Lys-Pro-Val-Ser-Xaa₃-Ser-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:437)

f433a) RHN-Lys-Pro-Val-Ser-Leu-Xaa₃-Tyr-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:438)

f431b) RHN-Lys-Pro-Val-Ser-Leu-Ser-Xaa₃-Arg-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:439)

f432b) RHN-Lys-Pro-Val-Ser-Leu-Ser-Tyr-Xaa₃-Xaa₁-Pro-Xaa₂-Arg-Phe-Xaa₄-[linker]-Leu-Lys-Trp-Ile-Gln-Glu-Tyr-Leu-Glu-Lys-Ala-Leu-Asn-(OH)NH₂ (SEQ ID NO:440)

SDF-1 (1-17)-[linker]-SDF-1 (5-67)-cyclic(Lys56-Glu60) acid or amide:

f433b) RHN-Lys-Pro-Val-Ser-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ liD NO:441)

f434) RHN-Xaa₃-Pro-Val-Ser-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:442)

f435) RHN-Lys-Xaa₃-Val-Ser-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:443)

f436) RHN-Lys-Pro-Xaa₃-Ser-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:444)

f437) RHN-Lys-Pro-Val-Xaa₃-Leu-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:445)

f438) RHN-Lys-Pro-Val-Ser-Xaa₃-Ser-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:446)

f439) RHN-Lys-Pro-Val-Ser-Leu-Xaa₃-Tyr-Arg-Xaa₁-Pro-Xaa₂-Arg-Phe-Phe-Glu-Ser-His-[linker]-Leu-Lys-Trp-Ile-Gln-Glu-Tyr-Leu-Glu-Lys-Ala-Leu-Asn-(OH)NH₂ (SEQ ID NO:447)

f440) RHN-Lys-Pro-Val-Ser-Leu-Ser-Xaa₃-Arg-Xaa₁-Pro-Xaa₂-Arg-Phe-Phe-Glu-Ser-His-[linker]-Leuf441) RHN-Lys-Pro-Val-Ser-Leu-Ser-Tyr-Xaa$_3$-Xaa$_1$-Pro-Xaa$_2$-Arg-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:449)

f442) RHN-Lys-Pro-Val-Ser-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:450)

f443) RHN-Xaa$_3$-Pro-Val-Ser-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:451)

f444) RHN-Lys-Xaa$_3$-Val-Ser-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:452)

f445) RHN-Lys-Pro-Xaa$_3$-Ser-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:453)

f446) RHN-Lys-Pro-Val-Xaa$_3$-Leu-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:454)

f447) RHN-Lys-Pro-Val-Ser-Xaa$_3$-Ser-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:455)

f448) RHN-Lys-Pro-Val-Ser-Leu-Xaa$_3$-Tyr-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:456)

f449) RHN-Lys-Pro-Val-Ser-Leu-Ser-Xaa$_3$-Arg-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:457)

f450) RHN-Lys-Pro-Val-Ser-Leu-Ser-Tyr-Xaa$_3$-Xaa$_1$-Pro-Xaa$_2$-Xaa$_4$-Phe-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:458)

f451) RHN-Lys-Pro-Val-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:459)

f452) RHN-Xaa$_3$-Pro-Val-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:460)

f453) RHN-Lys-Xaa$_3$-Val-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:461)

f454) RHN-Lys-Pro-Xaa$_3$-Ser-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:462)

f455) RHN-Lys-Pro-Val-Xaa$_3$-Leu-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:463)

f456) RHN-Lys-Pro-Val-Ser-Xaa$_3$-Ser-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:464)

f457) RHN-Lys-Pro-Val-Ser-Leu-Xaa$_3$-Tyr-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:465)

f458) RHN-Lys-Pro-Val-Ser-Leu-Ser-Xaa$_3$-Arg-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:466)

f459) RHN-Lys-Pro-Val-Ser-Leu-Ser-Tyr-Xaa$_3$-Xaa$_1$-Pro-Xaa$_2$-Arg-Xaa$_4$-Phe-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:467)

f460) RHN-Lys-Pro-Val-Ser-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:468)

f461) RHN-Xaa$_3$-Pro-Val-Ser-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:469)

f462) RHN-Lys-Xaa$_3$-Val-Ser-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:470)

f463) RHN-Lys-Pro-Xaa$_3$-Ser-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:471)

f464) RHN-Lys-Pro-Val-Xaa$_3$-Leu-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:472)

f465) RHN-Lys-Pro-Val-Ser-Xaa$_3$-Ser-Tyr-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:473)

f466) RHN-Lys-Pro-Val-Ser-Leu-Xaa$_3$-Tyr-Arg-Xaa$_1$-Pro-Xaa$_2$-Arg-Phe-Xaa$_4$-Glu-Ser-His-[linker]-Leuf467) RHN-Lys-Pro-Val-Ser-Leu-Ser-Xaa$_3$-Arg-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:475)

f468) RHN-Lys-Pro-Val-Ser-Leu-Ser-Tyr-Xaa$_3$-Xaa$_1$-Pro-Xaa$_2$-Arg-Phe-Xaa$_4$-Glu-Ser-His-[linker]-Leu-Lys-Trp-Ile-Gln-Glu-Tyr-Leu-Glu-Lys-Ala-Leu-Asn-(OH)NH$_2$ (SEQ ID NO:476)

f469) RHN-Lys-Pro-Val-Ser-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:477)

f470) RHN-Xaa$_3$-Pro-Val-Ser-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:478)

f471) RHN-Lys-Xaa$_3$-Val-Ser-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:479)

f472) RHN-Lys-Pro-Xaa$_3$-Ser-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:480)

f473) RHN-Lys-Pro-Val-Xaa$_3$-Leu-Ser-Tyr-Arg-Xaa$_1$-Pro-Xaa$_2$-Arg-Phe-Phe-Xaa$_4$-Ser-His-[linker]-Leu-Lys-Trp-Ile-Gln-Glu-4-Tyr-Leu-Glu-Lys-Ala-Leu-Asn-(OH)NH$_2$ (SEQ ID NO:481)

f474) RHN-Lys-Pro-Val-Ser-Xaa$_3$-Ser-Tyr-Arg-Xaa$_1$-Pro-Xaa$_2$-Arg-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:482)

f475) RHN-Lys-Pro-Val-Ser-Leu-Xaa$_3$-Tyr-Arg-Xaa$_1$-Pro-Xaa$_2$-Arg-Phe-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:483)

f476) RHN-Lys-Pro-Val-Ser-Leu-Ser-Xaa$_3$-Arg-Xaa$_1$-Pro-Xaa$_2$-Arg-Phe-Xaa$_4$-Ser-His-[linker]-Leu-Lys-Trp-Ile-Gln-Glu-Tyr-Leu-Glu-Lys-Ala-Leu-Asn-(OH)NH$_2$ (SEQ ID NO:484)

f477) RHN-Lys-Pro-Val-Ser-Leu-Ser-Tyr-Xaa$_3$-Xaa$_1$-Pro-Xaa$_2$-Arg-Phe-Phe-Xaa$_4$ s-Ser-His-[linker]-Leu-Lys-Trp-Ile-Gln-Glu-Tyr-Leu-Glu-Lys-Ala-Leu-Asn-(OH)NH$_2$ (SEQ ID NO:485)

f478) RHN-Lys-Pro-Val-Ser-Leu-Ser-Tyr-Arg-Xaa$_1$-Pro-Xaa$_2$-Arg-Phe-Phe-Glu-Xaa$_4$-His-[linker]-Leu-Lys-Trp-Ile-Gln-Glu-Tyr-Leu-Glu-Lys-Ala-Leu-Asn-(OH)NH$_2$ (SEQ ID NO:486)

f479) RHN-Xaa$_3$-Pro-Val-Ser-Leu-Ser-Tyr-Arg-Xaa$_1$-Pro-Xaa$_2$-Arg-Phe-Phe-Glu-Xaa$_4$-His-[linker]-Leu-Lys-Trp-Ile-Gln-Glu-Tyr-Leu-Glu-Lys-Ala-Leu-Asn-(OH)NH$_2$ (SEQ ID NO:487)

f480) RHN-Lys-Xaa$_3$-Val-Ser-Leu-Ser-Tyr-Arg-Xaa$_1$-Pro-Xaa$_2$-Arg-Phe-Phe-Glu-Xaa$_4$-His-[linker]-Leu-Lys-Trp-Ile-Gln-Glu-Tyr-Leu-Glu-Lys-Ala-Leu-Asn-(OH)NH$_{12}$ (SEQ ID NO:488)

f481) RHN-Lys-Pro-Xaa$_3$-Ser-Leu-Ser-Tyr-Arg-Xaa$_1$-Pro-Xaa$_2$-Arg-Phe-Phe-Glu-Xaa$_4$-His-[linker]-Leu-Lys-Trp-Ile-Gln-Glu-Tyr-Leu-Glu-Lys-Ala-Leu-Asn-(OH)NH$_2$ (SEQ ID NO:489)

f482) RHN-Lys-Pro-Val-Xaa$_3$-Leu-Ser-Tyr-Arg-Xaa$_1$-Pro-Xaa$_2$-Arg-Phe-Phe-Glu-Xaa$_4$-His-[linker]-Leu-Lys-Trp-Ile-Gln-Glu-Tyr-Leu-Glu-Lys-Ala-Leu-Asn-(OH)NH$_2$ (SEQ ID NO:490)

f483) RHN-Lys-Pro-Val-Ser-Xaa$_3$-Ser-Tyr-Arg-Xaa$_1$-Pro-Xaa$_2$-Arg-Phe-Phe-Glu-Xaa$_4$-His-[linker]-Leu-Lys-Trp-Ile-Gln-Glu-Tyr-Leu-Glu-Lys-Ala-Leu-Asn-(OH)NH$_2$ (SEQ ID NO:491)

f484) RHN-Lys-Pro-Val-Ser-Leu-Xaa$_3$-Tyr-Arg-Xaa$_1$-Pro-Xaa$_2$-Arg-Phe-Phe-Glu-Xaa$_4$-His-[linker]-Leu-Lys-Trp-Ile-Gln-Glu-Tyr-Leu-Glu-Lys-Ala-Leu-Asn-(OH)NH$_2$ (SEQ ID NO:492)

f485) RHN-Lys-Pro-Val-Ser-Leu-Ser-Xaa$_3$-Arg-Xaa$_1$-Pro-Xaa$_2$-Arg-Phe-Phe-Glu-Xaa$_4$-His-[linker]-Leu-Lys-Trp-Ile-Gln-Glu-Tyr-Leu-Glu-Lys-Ala-Leu-Asn-(OH)NH$_2$ (SEQ ID NO:493)

f486) RHN-Lys-Pro-Val-Ser-Leu-Ser-Tyr-Xaa$_3$-Xaa$_1$-Pro-Xaa$_2$-Arg-Phe-Phe-Glu-Xaa$_4$-His-[linker]-Leu-Lys-Trp-Ile-Gln-Glu-Tyr-Leu-Glu-Lys-Ala-Leu-Asn-(OH)NH$_2$ (SEQ ID NO:494)

f487) RHN-Lys-Pro-Val-Ser-Leu-Ser-Tyr-Arg-Xaa$_1$-Pro-Xaa$_2$-Arg-Phe-Phe-Glu-Ser-Xaa$_4$-[linker]-Leu-Lys-Trp-Ile-Gln-Glu-Tyr-Leu-Glu-Lys-Ala-Leu-Asn-(OH)NH$_2$ (SEQ ID NO:495)

f488) RHN-Xaa$_3$-Pro-Val-Ser-Leu-Ser-Tyr-Arg-Xaa$_1$-Pro-Xaa$_2$-Arg-Phe-Phe-Glu-Ser-Xaa$_4$-[linker]-Leu-Lys-Trp-Ile-Gln-Glu-Tyr-Leu-Glu-Lys-Ala-Leu-Asn-(OH)NH$_{12}$ (SEQ ID NO:496)

f489) RHN-Lys-Xaa$_3$-Val-Ser-Leu-Ser-Tyr-Arg-Xaa$_1$-Pro-Xaa$_2$-Arg-Phe-Phe-Glu-Ser-Xaa$_4$-[linker]-Leu-Lys-Trp-Ile-Gln-Glu-Tyr-Leu-Glu-Lys-Ala-Leu-Asn-(OH)NH$_2$ (SEQ ID NO:497)

f490) RHN-Lys-Pro-Xaa$_3$-Ser-Leu-Ser-Tyr-Arg-Xaa$_1$-Pro-Xaa$_2$-Arg-Phe-Phe-Glu-Ser-Xaa$_4$-[linker]-Leu-Lys-Trp-Ile-Gln-Glu-Tyr-Leu-Glu-Lys-Ala-Leu-Asn-(OH)NH$_2$ (SEQ ID NO:498)

f491) RHN-Lys-Pro-Val-Xaa$_3$-Leu-Ser-Tyr-Arg-Xaa$_1$-Pro-Xaa$_2$-Arg-Phe-Phe-Glu-Ser-Xaa$_4$-[linker]-Leu-Lys-Trp-Ile-Gln-Glu-Tyr-Leu-Glu-Lys-Ala-Leu-Asn-(OH)NH$_2$ (SEQ ID NO:499)

f492) RHN-Lys-Pro-Val-Ser-Xaa$_3$-Ser-Tyr-Arg-Xaa$_1$-Pro-Xaa$_2$-Arg-Phe-Phe-Glu-Ser-Xaa$_4$-[linker]-Leu- Lys-Trp-Ile-Gln-
G̲l̲u̲-Tyr-Leu-Glu-Lys-Ala-Leu-Asn-(OH)NH$_2$ (SEQ ID
N̲O̲:500)

f493) RHN-Lys-Pro-Val-Ser-Leu-Xaa$_3$-Tyr-Arg-Xaa$_1$-Pro-Xaa$_2$-Arg-Phe-Phe-Glu-Ser-Xaa$_4$-[linker]-Leu-Lys-Trp-Ile-Gln-
G̲l̲u̲-Tyr-Leu-Glu-Lys-Ala-Leu-Asn-(OH)NH$_2$ (SEQ ID
N̲O̲:501)

f494) RHN-Lys-Pro-Val-Ser-Leu-Ser-Xaa$_3$-Arg-Xaa$_1$-Pro-Xaa$_2$-Arg-Phe-Phe-Glu-Ser-Xaa$_4$-[linker]-Leu-Lys-Trp-Ile-Gln-
G̲l̲u̲-Tyr-Leu-Glu-Lys-Ala-Leu-Asn-(OH)NH$_2$ (SEQ ID
N̲O̲:502)

f495) RHN-Lys-Pro-Val-Ser-Leu-Ser-Tyr-Xaa$_3$-Xaa$_1$-Pro-Xaa$_2$-Arg-Phe-Phe-Glu-Ser-Xaa$_4$-[linker]-Leu-Lys-Trp-Ile-Gln-
G̲l̲u̲-Tyr-Leu-Glu-Lys-Ala-Leu-Asn-(OH)NH$_2$ (SEQ ID
N̲O̲:503)

Similarly, cyclic polypeptides may be prepared using sequences from chemokines other than SDF-1. Such as residues 35-49, 10-49, or 55-69 of MIP-1α:

For instance preferred embodiments of cyclic hybrid analogs: SDF-1/MIP-1α were prepared by linking together the SDF-1 N-terminal region and residues 35-49 of the MIP-1α C-terminal region. The C-terminal region was cyclized by etherification reaction between residue Thr$^{44}$ and residue Ser$^{47}$ (underlined).

SDF-1 (1-14)-[linker]-MIP-1α (35-49)-cyclic(Thr$^{44}$-Ser$^{47}$) acid or amide f496) RHN-Lys-Pro-Val-Ser-Leu-Ser-Tyr-Arg-Xaa$_1$-Pro-Xaa$_2$-Arg-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:504)

f497) RHN-Xaa$_3$-Pro-Val-Ser-Leu-Ser-Tyr-Arg-Xaa$_1$-Pro-Xaa$_2$-Arg-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:505)

f498) RHN-Lys-Xaa$_3$-Val-Ser-Leu-Ser-Tyr-Arg-Xaa$_1$-Pro-Xaa$_2$-Arg-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:506)

f499) RHN-Lys-Pro-Xaa$_3$-Ser-Leu-Ser-Tyr-Arg-Xaa$_1$-Pro-Xaa$_2$-Arg-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:507)

f500) RHN-Lys-Pro-Val-Xaa$_3$-Leu-Ser-Tyr-Arg-Xaa$_1$-Pro-Xaa$_2$-Arg-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:508)

f501) RHN-Lys-Pro-Val-Ser-Xaa$_3$-Ser-Tyr-Arg-Xaa$_1$-Pro-Xaa$_2$-Arg-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:509)

f502) RHN-Lys-Pro-Val-Ser-Leu-Xaa$_3$-Tyr-Arg-Xaa$_1$-Pro-Xaa$_2$-Arg-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:510)

f503) RHN-Lys-Pro-Val-Ser-Leu-Ser-Xaa$_3$-Arg-Xaa$_1$-Pro-Xaa$_2$-Arg-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:511)

f504) RHN-Lys-Pro-Val-Ser-Leu-Ser-Tyr-Xaa$_3$-Xaa$_1$-Pro-Xaa$_2$-Arg-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:512)

f505) RHN-Lys-Pro-Val-Ser-Leu-Ser-Tyr-Arg-Xaa$_1$-Pro-Xaa$_2$-Xaa$_4$-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:513)

f506) RHN-Xaa$_3$-Pro-Val-Ser-Leu-Ser-Tyr-Arg-Xaa$_1$-Pro-Xaa$_2$-Xaa$_4$-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:514)

f507) RHN-Lys-Xaa$_3$-Val-Ser-Leu-Ser-Tyr-Arg-Xaa$_1$-Pro-Xaa$_2$-Xaa$_4$-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:515)

f508) RHN-Lys-Pro-Xaa$_3$-Ser-Leu-Ser-Tyr-Arg-Xaa$_1$-Pro-Xaa$_2$-Xaa$_4$-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:516)

f509) RHN-Lys-Pro-Val-Xaa$_3$-Leu-Ser-Tyr-Arg-Xaa$_1$-Pro-Xaa$_2$-Xaa$_4$-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:517)

f510) RHN-Lys-Pro-Val-Ser-Xaa$_3$-Ser-Tyr-Arg-Xaa$_1$-Pro-Xaa$_2$-Xaa$_4$-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:518)

f511) RHN-Lys-Pro-Val-Ser-Leu-Xaa$_3$-Tyr-Arg-Xaa$_1$-Pro-Xaa$_2$-Xaa$_4$-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:519)

f512) RHN-Lys-Pro-Val-Ser-Leu-Ser-Xaa$_3$-Arg-Xaa$_1$-Pro-Xaa$_2$-Xaa$_4$-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:520)

f513) RHN-Lys-Pro-Val-Ser-Leu-Ser-Tyr-Xaa$_3$-Xaa$_1$-Pro-Xaa$_2$-Xaa$_4$-Phe-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:521)

f514) RHN-Lys-Pro-Val-Ser-Leu-Ser-Tyr-Arg-Xaa$_1$-Pro-Xaa$_2$-Arg-Xaa$_4$-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:522)

f515) RHN-Xaa$_3$-Pro-Val-Ser-Leu-Ser-Tyr-Arg-Xaa$_1$-Pro-Xaa$_2$-Arg-Xaa$_4$-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:523)

f516) RHN-Lys-Xaa$_3$-Val-Ser-Leu-Ser-Tyr-Arg-Xaa$_1$-Pro-Xaa$_2$-Arg-Xaa$_4$-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:524)

f517) RHN-Lys-Pro-Xaa$_3$-Ser-Leu-Ser-Tyr-Arg-Xaa$_1$-Pro-Xaa$_2$-Arg-Xaa$_4$-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:525)

f518) RHN-Lys-Pro-Val-Xaa$_3$-Leu-Ser-Tyr-Arg-Xaa$_1$-Pro-Xaa$_2$-Arg-Xaa$_4$-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:526)

f519) RHN-Lys-Pro-Val-Ser-Xaa$_3$-Ser-Tyr-Arg-Xaa$_1$-Pro-Xaa$_2$-Arg-Xaa$_4$-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:527)

f520) RHN-Lys-Pro-Val-Ser-Leu-Xaa$_3$-Tyr-Arg-Xaa$_1$-Pro-Xaa$_2$-Arg-Xaa$_4$-Phe-[linker]-Ser-Lys-Pro-Gly-Val-Ile-Phe-Leu-T̲h̲r̲-Lys-Arg-S̲e̲r̲-Arg-Gln-Val-(OH)NH$_2$ (SEQ ID NO:528)

f521) RHN-Lys-Pro-Val-Ser-Leu-Ser-Xaa$_3$-Arg-Xaa$_1$-Pro-Xaa$_2$-Arg-Xaa$_4$-Phe-[linker]-Ser-Lys-Pro-Gly-Val-Ile-Phe-Leu-Thr-Lys-Arg-Ser-Arg-Gln-Val-(OH)NH$_2$ (SEQ ID NO:529)

f522) RHN-Lys-Pro-Val-Ser-Leu-Ser-Tyr-Xaa$_3$-Xaa$_1$-Pro-Xaa$_2$-Arg-Xaa$_4$-Phe-[linker]-Ser-Lys-Pro-Gly-Val-Ile-Phe-Leu-Thr-Lys-Arg-Ser-Arg-Gln-Val-(OH)NH$_2$ (SEQ ID NO:530)

f523) RHN-Lys-Pro-Val-Ser-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:531)

f524) RHN-Xaa$_3$-Pro-Val-Ser-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:532)

f525) RHN-Lys-Xaa$_3$-Val-Ser-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:533)

f526) RHN-Lys-Pro-Xaa$_3$-Ser-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:534)

f527) RHN-Lys-Pro-Val-Xaa$_3$-Leu-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:535)

f528) RHN-Lys-Pro-Val-Ser-Xaa$_3$-Ser-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:536)

f529) RHN-Lys-Pro-Val-Ser-Leu-Xaa$_3$-Tyr-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:537)

f530) RHN-Lys-Pro-Val-Ser-Leu-Ser-Xaa$_3$-Arg-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:538)

f531) RHN-Lys-Pro-Val-Ser-Leu-Ser-Tyr-Xaa$_3$-Xaa$_1$-Pro-Xaa$_2$-Arg-Phe-Xaa$_4$-[linker]-Ser-Lys-Pro-Gly-Val-Ile-Phe-Leu-Thr-Lys-Arg-Ser-Arg-Gln-Val-(OH)NH$_2$ (SEQ ID NO:539)

SDF-1 (1-17)[linker]-MIP-1α (35-49)-cyclic(Thr44-Ser47) acid or amide f532) RHN-Lys-Pro-Val-Ser-Leu-Ser-Tyr-Arg-Xaa$_1$-Pro-Xaa$_2$-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:540)

f533) RHN-Xaa$_3$-Pro-Val-Ser-Leu-Ser-Tyr-Arg-Xaa$_1$-Pro-Xaa$_2$-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:541)

f534) RHN-Lys-Xaa$_3$-Val-Ser-Leu-Ser-Tyr-Arg-Xaa$_1$-Pro-Xaa$_2$-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:542)

f535) RHN-Lys-Pro-Xaa$_3$-Ser-Leu-Ser-Tyr-Arg-Xaa$_1$-Pro-Xaa$_2$-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:543)

f536) RHN-Lys-Pro-Val-Xaa$_3$-Leu-Ser-Tyr-Arg-Xaa$_1$-Pro-Xaa$_2$-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:544)

f537) RHN-Lys-Pro-Val-Ser-Xaa$_3$-Ser-Tyr-Arg-Xaa$_1$-Pro-Xaa$_2$-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:545)

f538) RHN-Lys-Pro-Val-Ser-Leu-Xaa$_3$-Tyr-Arg-Xaa$_1$-Pro-Xaa$_2$-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:546)

f539) RHN-Lys-Pro-Val-Ser-Leu-Ser-Xaa$_3$-Arg-Xaa$_1$-Pro-Xaa$_2$-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:547)

f540) RHN-Lys-Pro-Val-Ser-Leu-Ser-Tyr-Xaa$_3$-Xaa$_1$-Pro-Xaa$_2$-Arg-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:548)

f541) RHN-Lys-Pro-Val-Ser-Leu-Ser-Tyr-Arg-Xaa$_1$-Pro-Xaa$_2$-Xaa$_4$-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:549)

f542) RHN-Xaa$_3$-Pro-Val-Ser-Leu-Ser-Tyr-Arg-Xaa$_1$-Pro-Xaa$_2$-Xaa$_4$-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:550)

f543) RHN-Lys-Xaa$_3$-Val-Ser-Leu-Ser-Tyr-Arg-Xaa$_1$-Pro-Xaa$_2$-Xaa$_4$-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:551)

f544) RHN-Lys-Pro-Xaa$_3$-Ser-Leu-Ser-Tyr-Arg-Xaa$_1$-Pro-Xaa$_2$-Xaa$_4$-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:552)

f545) RHN-Lys-Pro-Val-Xaa$_3$-Leu-Ser-Tyr-Arg-Xaa$_1$-Pro-Xaa$_2$-Xaa$_4$-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:553)

f546) RHN-Lys-Pro-Val-Ser-Xaa$_3$-Ser-Tyr-Arg-Xaa$_1$-Pro-Xaa$_2$-Xaa$_4$-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:554)

f547) RHN-Lys-Pro-Val-Ser-Leu-Xaa$_3$-Tyr-Arg-Xaa$_1$-Pro-Xaa$_2$-Xaa$_4$-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:555)

f548) RHN-Lys-Pro-Val-Ser-Leu-Ser-Xaa$_3$-Arg-Xaa$_1$-Pro-Xaa$_2$-Xaa$_4$-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:556)

f549) RHN-Lys-Pro-Val-Ser-Leu-Ser-Tyr-Xaa$_3$-Xaa$_1$-Pro-Xaa$_2$-Xaa$_4$-Phe-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:557)

f550) RHN-Lys-Pro-Val-Ser-Leu-Ser-Tyr-Arg-Xaa$_1$-Pro-Xaa$_2$-Arg-Xaa$_4$-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:558)

f551) RHN-Xaa$_3$-Pro-Val-Ser-Leu-Ser-Tyr-Arg-Xaa$_1$-Pro-Xaa$_2$-Arg-Xaa$_4$-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:559)

f552) RHN-Lys-Xaa$_3$-Val-Ser-Leu-Ser-Tyr-Arg-Xaa$_1$-Pro-Xaa$_2$-Arg-Xaa$_4$-Phe-Glu-Ser-His-[linker]-Ser-Lys-Pro-Gly-Val-Ile-Phe-Leu-Thr-Lys-Arg-Ser-Arg-Gln-Val-(OH)NH$_2$ (SEQ ID NO:560)

f553) RHN-Lys-Pro-Xaa$_3$-Ser-Leu-Ser-Tyr-Arg-Xaa$_1$-Pro-Xaa$_2$-Arg-Xaa$_4$-Phe-Glu-Ser-His-[linker]-Ser-Lys-Prof554) RHN-Lys-Pro-Val-Xaa₃-Leu-Ser-Tyr-Arg-Xaa₁-Pro-
Xaa₂-Arg-Xaa₄-Phe-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:562)

f555) RHN-Lys-Pro-Val-Ser-Xaa₃-Ser-Tyr-Arg-Xaa₁-Pro-
Xaa₂-Arg-Xaa₄-Phe-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:563)

f556) RHN-Lys-Pro-Val-Ser-Leu-Xaa₃-Tyr-Arg-Xaa₁-Pro-
Xaa₂-Arg-Xaa₄-Phe-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:564)

f557) RHN-Lys-Pro-Val-Ser-Leu-Ser-Xaa₃-Arg-Xaa₁-Pro-
Xaa₂-Arg-Xaa₄-Phe-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:565)

f558) RHN-Lys-Pro-Val-Ser-Leu-Ser-Tyr-Xaa₃-Xaa₁-Pro-
Xaa₂-Arg-Xaa₄-Phe-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:566)

f559) RHN-Lys-Pro-Val-Ser-Leu-Ser-Tyr-Arg-Xaa₁-Pro-
Xaa₂-Arg-Phe-Xaa₄-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:567)

f560) RHN-Xaa₃-Pro-Val-Leu-Ser-Tyr-Arg-Xaa₁-Pro-
Xaa₂-Arg-Phe-Xaa₄-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:568)

f561) RHN-Lys-Xaa₃-Val-Ser-Leu-Ser-Tyr-Arg-Xaa₁-Pro-
Xaa₂-Arg-Phe-Xaa₄-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:569)

f562) RHN-Lys-Pro-Xaa₃-Leu-Ser-Tyr-Arg-Xaa₁-Pro-
Xaa₂-Arg-Phe-Xaa₄-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:570)

f563) RHN-Lys-Pro-Val-Xaa₃-Leu-Ser-Tyr-Arg-Xaa₁-Pro-
Xaa₂-Arg-Phe-Xaa₄-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:571)

f564) RHN-Lys-Pro-Val-Ser-Xaa₃-Ser-Tyr-Arg-Xaa₁-Pro-
Xaa₂-Arg-Phe-Xaa₄-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:572)

f565) RHN-Lys-Pro-Val-Ser-Leu-Xaa₃-Tyr-Arg-Xaa₁-Pro-
Xaa₂-Arg-Phe-Xaa₄-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:573)

f566) RHN-Lys-Pro-Val-Ser-Leu-Ser-Xaa₃-Arg-Xaa₁-Pro-
Xaa₂-Arg-Phe-Xaa₄-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:574)

f567) RHN-Lys-Pro-Val-Ser-Leu-Ser-Tyr-Xaa₃-Xaa₁-Pro-
Xaa₂-Arg-Phe-Xaa₄-Glu-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:575)

f568) RHN-Lys-Pro-Val-Ser-Leu-Ser-Tyr-Arg-Xaa₁-Pro-
Xaa₂-Arg-Phe-Phe-Xaa₄-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:576)

f569) RHN-Xaa₃-Pro-Val-Ser-Leu-Ser-Tyr-Arg-Xaa₁-Pro-
Xaa₂-Arg-Phe-Xaa₄-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:577)

f570) RHN-Lys-Xaa₃-Val-Ser-Leu-Ser-Tyr-Arg-Xaa₁-Pro-
Xaa₂-Arg-Phe-Phe-Xaa₄-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:578)

f571) RHN-Lys-Pro-Xaa₃-Ser-Leu-Ser-Tyr-Arg-Xaa₁-Pro-
Xaa₂-Arg-Phe-Phe-Xaa₄-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:579)

f572) RHN-Lys-Pro-Val-Xaa₃-Leu-Ser-Tyr-Arg-Xaa₁-Pro-
Xaa₂-Arg-Phe-Phe-Xaa₄-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:580)

f573) RHN-Lys-Pro-Val-Ser-Xaa₃-Ser-Tyr-Arg-Xaa₁-Pro-
Xaa₂-Arg-Phe-Phe-Xaa₄-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:581)

f574) RHN-Lys-Pro-Val-Ser-Leu-Xaa₃-Tyr-Arg-Xaa₁-Pro-
Xaa₂-Arg-Phe-Phe-Xaa₄-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:582)

f575) RHN-Lys-Pro-Val-Ser-Leu-Ser-Xaa₃-Arg-Xaa₁-Pro-
Xaa₂-Arg-Phe-Phe-Xaa₄-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:583)

f576) RHN-Lys-Pro-Val-Ser-Leu-Ser-Tyr-Xaa₃-Xaa₁-Pro-
Xaa₂-Arg-Phe-Phe-Xaa₄-Ser-His-[linker]-Ser-Lys-Pro-
Gly-Val-Ile-Phe-Leu-Thr-Lys-Arg-
Ser-Arg-Gln-Val-(OH)NH₂ (SEQ ID NO:584)

f577) RHN-Lys-Pro-Val-Ser-Leu-Ser-Tyr-Arg-Xaa₁-Pro-
Xaa₂-Arg-Phe-Phe-Glu-Xaa₄-His-[linker]-Ser-Lys-Pro-
Gly-Val-Ile-Phe-Leu-Thr-Lys-Arg-
Ser-Arg-Gln-Val-(OH)NH₂ (SEQ ID NO:585)

f578) RHN-Xaa₃-Pro-Val-Ser-Leu-Ser-Tyr-Arg-Xaa₁-Pro-
Xaa₂-Arg-Phe-Phe-Glu-Xaa₄-His-[linker]-Ser-Lys-Pro-
Gly-Val-Ile-Phe-Leu-Thr-Lys-Arg-
Ser-Arg-Gln-Val-(OH)NH₂ (SEQ ID NO:586)

f579) RHN-Lys-Xaa₃-Val-Ser-Leu-Ser-Tyr-Arg-Xaa₁-Pro-
Xaa₂-Arg-Phe-Phe-Glu-Xaa₄-His-[linker]-Ser-Lys-Pro-
Gly-Val-Ile-Phe-Leu-Thr-Lys-Arg-
Ser-Arg-Gln-Val-(OH)NH₂ (SEQ ID NO:587)

f580) RHN-Lys-Pro-Xaa₃-Ser-Leu-Ser-Tyr-Arg-Xaa₁-Pro-
Xaa₂-Arg-Phe-Phe-Glu-Xaa₄-His-[linker]-Ser-Lys-Pro-
Gly-Val-Ile-Phe-Leu-Thr-Lys-Arg-
Ser-Arg-Gln-Val-(OH)NH₂ (SEQ ID NO:588)

f581) RHN-Lys-Pro-Val-Xaa₃-Leu-Ser-Tyr-Arg-Xaa₁-Pro-
Xaa₂-Arg-Phe-Phe-Glu-Xaa₄-His-[linker]-Ser-Lys-Pro-
Gly-Val-Ile-Phe-Leu-Thr-Lys-Arg-
Ser-Arg-Gln-Val-(OH)NH₂ (SEQ ID NO:589)

f582) RHN-Lys-Pro-Val-Ser-Xaa₃-Ser-Tyr-Arg-Xaa₁-Pro-
Xaa₂-Arg-Phe-Phe-Glu-Xaa₄-His-[linker]-Ser-Lys-Pro-
Gly-Val-Ile-Phe-Leu-Thr-Lys-Arg-
Ser-Arg-Gln-Val-(OH)NH₂ (SEQ ID NO:590)

f583) RHN-Lys-Pro-Val-Ser-Leu-Xaa₃-Tyr-Arg-Xaa₁-Pro-
Xaa₂-Arg-Phe-Phe-Glu-Xaa₄-His-[linker]-Ser-Lys-Pro-
Gly-Val-Ile-Phe-Leu-Thr-Lys-Arg-
Ser-Arg-Gln-Val-(OH)NH₂ (SEQ ID NO:591)

f584) RHN-Lys-Pro-Val-Ser-Leu-Ser-Xaa₃-Arg-Xaa₁-Pro-
Xaa₂-Arg-Phe-Phe-Glu-Xaa₄-His-[linker]-Ser-Lys-Pro-
Gly-Val-Ile-Phe-Leu-Thr-Lys-Arg-
Ser-Arg-Gln-Val-(OH)NH₂ (SEQ ID NO:592)

f585) RHN-Lys-Pro-Val-Ser-Leu-Ser-Tyr-Xaa₃-Xaa₁-Pro-
Xaa₂-Arg-Phe-Phe-Glu-Xaa₄-His-[linker]-Ser-Lys-Pro-
Gly-Val-Ile-Phe-Leu-Thr-Lys-Arg-
Ser-Arg-Gln-Val-(OH)NH₂ (SEQ ID NO:593)

f586) RHN-Lys-Pro-Val-Ser-Leu-Ser-Tyr-Arg-Xaa₁-Pro-
Xaa₂-Arg-Phe-Phe-Glu-Ser-Xaa₄-[linker]-Ser-Lys-Prof587) RHN-Xaa₃-Pro-Val-Ser-Leu-Ser-Tyr-Arg-Xaa₁-Pro-Xaa₂-Arg-Phe-Phe-Glu-Ser-Xaa₄-[linker]-Ser-Lys-Pro-Gly-Val-Ile-Phe-Leu-Thr-Lys-Arg-Ser-Arg-Gln-Val-(OH)NH₂ (SEQ ID NO:594)

f587) RHN-Xaa₃-Pro-Val-Ser-Leu-Ser-Tyr-Arg-Xaa₁-Pro-Xaa₂-Arg-Phe-Phe-Glu-Ser-Xaa₄-[linker]-Ser-Lys-Pro-Gly-Val-Ile-Phe-Leu-Thr-Lys-Arg-Ser-Arg-Gln-Val-(OH)NH₂ (SEQ ID NO:595)

f588) RHN-Lys-Xaa₃-Val-Ser-Leu-Ser-Tyr-Arg-Xaa₁-Pro-Xaa₂-Arg-Phe-Phe-Glu-Ser-Xaa₄-[linker]-Ser-Lys-Pro-Gly-Val-Ile-Phe-Leu-Thr-Lys-Arg-Ser-Arg-Gln-Val-(OH)NH₂ (SEQ ID NO:596)

f589) RHN-Lys-Pro-Xaa₃-Ser-Leu-Ser-Tyr-Arg-Xaa₁-Pro-Xaa₂-Arg-Phe-Phe-Glu-Ser-Xaa₄-[linker]-Ser-Lys-Pro-Gly-Val-Ile-Phe-Leu-Thr-Lys-Arg-Ser-Arg-Gln-Val-(OH)NH₂ (SEQ ID NO:597)

f590) RHN-Lys-Pro-Val-Xaa₃-Leu-Ser-Tyr-Arg-Xaa₁-Pro-Xaa₂-Arg-Phe-Phe-Glu-Ser-Xaa₄-[linker]-Ser-Lys-Pro-Gly-Val-Ile-Phe-Leu-Thr-Lys-Arg-Ser-Arg-Gln-Val-(OH)NH₂ (SEQ ID NO:598)

f591) RHN-Lys-Pro-Val-Ser-Xaa₃-Ser-Tyr-Arg-Xaa₁-Pro-Xaa₂-Arg-Phe-Phe-Glu-Ser-Xaa₄-[linker]-Ser-Lys-Pro-Gly-Val-Ile-Phe-Leu-Thr-Lys-Arg-Ser-Arg-Gln-Val-(OH)NH₂ (SEQ ID NO:599)

f592) RHN-Lys-Pro-Val-Ser-Leu-Xaa₃-Tyr-Arg-Xaa₁-Pro-Xaa₂-Arg-Phe-Phe-Glu-Ser-Xaa₄-[linker]-Ser-Lys-Pro-Gly-Val-Ile-Phe-Leu-Thr-Lys-Arg-Ser-Arg-Gln-Val-(OH)NH₂ (SEQ ID NO:600)

f593) RHN-Lys-Pro-Val-Ser-Leu-Ser-Xaa₃-Arg-Xaa₁-Pro-Xaa₂-Arg-Phe-Phe-Glu-Ser-Xaa₄-[linker]-Ser-Lys-Pro-Gly-Val-Ile-Phe-Leu-Thr-Lys-Arg-Ser-Arg-Gln-Val-(OH)NH₂ (SEQ ID NO:601)

f594) RHN-Lys-Pro-Val-Ser-Leu-Ser-Tyr-Xaa₃-Xaa₁-Pro-Xaa₂-Arg-Phe-Phe-Glu-Ser-Xaa₄-[linker]-Ser-Lys-Pro-Gly-Val-Ile-Phe-Leu-Thr-Lys-Arg-Ser-Arg-Gln-Val-(OH)NH₂ (SEQ ID NO:602)

More preferred embodiments of cyclic hybrid analogs: SDF-1/MIP-1α were prepared by linking together the SDF-1 N-terminal region and residues 56-69 of the MIP-1α C-terminal region. The C-terminal region was cyclized by lactamization reaction between residue Lys⁶¹ and residue Asp⁶⁴ (underlined).

SDF-(1-14)-[linker]-MIP-1α (55-69)-cyclic(Lys61-Asp64) acid or amide f595) RHN-Lys-Pro-Val-Ser-Leu-Ser-Tyr-Arg-Xaa₁-Pro-Xaa₂-Arg-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:603)

f596) RHN-Xaa₃-Pro-Val-Ser-Leu-Ser-Tyr-Arg-Xaa₁-Pro-Xaa₂-Arg-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:604)

f597) RHN-Lys-Xaa₃-Val-Ser-Leu-Ser-Tyr-Arg-Xaa₁-Pro-Xaa₂-Arg-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:605)

f598) RHN-Lys-Pro-Xaa₃-Ser-Leu-Ser-Tyr-Arg-Xaa₁-Pro-Xaa₂-Arg-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:606)

f599) RHN-Lys-Pro-Val-Xaa₃-Leu-Ser-Tyr-Arg-Xaa₁-Pro-Xaa₂-Arg-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:607)

f600) RHN-Lys-Pro-Val-Ser-Xaa₃-Ser-Tyr-Arg-Xaa₁-Pro-Xaa₂-Arg-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:608)

f601) RHN-Lys-Pro-Val-Ser-Leu-Xaa₃-Tyr-Arg-Xaa₁-Pro-Xaa₂-Arg-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:609)

f602) RHN-Lys-Pro-Val-Ser-Leu-Ser-Xaa₃-Arg-Xaa₁-Pro-Xaa₂-Arg-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:610)

f603) RHN-Lys-Pro-Val-Ser-Leu-Ser-Tyr-Xaa₃-Xaa₁-Pro-Xaa₂-Arg-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:611)

f604) RHN-Lys-Pro-Val-Ser-Leu-Ser-Tyr-Arg-Xaa₁-Pro-Xaa₂-Xaa₄-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:612)

f605) RHN-Xaa₃-Pro-Val-Ser-Leu-Ser-Tyr-Arg-Xaa₁-Pro-Xaa₂-Xaa₄-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:613)

f606) RHN-Lys-Xaa₃-Val-Ser-Leu-Ser-Tyr-Arg-Xaa₁-Pro-Xaa₂-Xaa₄-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:614)

f607) RHN-Lys-Pro-Xaa₃-Ser-Leu-Ser-Tyr-Arg-Xaa₁-Pro-Xaa₂-Xaa₄-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:615)

f608) RHN-Lys-Pro-Val-Xaa₃-Leu-Ser-Tyr-Arg-Xaa₁-Pro-Xaa₂-Xaa₄-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:616)

f609) RHN-Lys-Pro-Val-Ser-Xaa₃-Ser-Tyr-Arg-Xaa₁-Pro-Xaa₂-Xaa₄-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:617)

f610) RHN-Lys-Pro-Val-Ser-Leu-Xaa₃-Tyr-Arg-Xaa₁-Pro-Xaa₂-Xaa₄-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:618)

f611) RHN-Lys-Pro-Val-Ser-Leu-Ser-Xaa₃-Arg-Xaa₁-Pro-Xaa₂-Xaa₄-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:619)

f612) RHN-Lys-Pro-Val-Ser-Leu-Ser-Tyr-Xaa₃-Xaa₁-Pro-Xaa₂-Xaa₄-Phe-Phe-[linker]-Glu-Glu-Trp-Val-Gln-Lys-Tyr-Val-Asp-Asp-Leu-Glu-Leu-Ser-Ala-(OH)NH₂ (SEQ ID NO:620)

f613) RHN-Lys-Pro-Val-Ser-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:621)

f614) RHN-Xaa₃-Pro-Val-Ser-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:622)

f615) RHN-Lys-Xaa₃-Val-Ser-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:623)

f616) RHN-Lys-Pro-Xaa₃-Ser-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:624)

f617) RHN-Lys-Pro-Val-Xaa$_3$-Leu-Ser-Tyr-Arg-Xaa$_1$-Pro-Xaa$_2$-Arg-Xaa$_4$-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:625)

f618) RHN-Lys-Pro-Val-Ser-Xaa$_3$-Ser-Tyr-Arg-Xaa$_1$-Pro-Xaa$_2$-Arg-Xaa$_4$-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:626)

f619) RHN-Lys-Pro-Val-Ser-Leu-Xaa$_3$-Tyr-Arg-Xaa$_1$-Pro-Xaa$_2$-Arg-Xaa$_4$-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:627)

f620) RHN-Lys-Pro-Val-Ser-Leu-Ser-Xaa$_3$-Arg-Xaa$_1$-Pro-Xaa$_2$-Arg-Xaa$_4$-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:628)

f621) RHN-Lys-Pro-Val-Ser-Leu-Ser-Tyr-Xaa$_3$-Xaa$_1$-Pro-Xaa$_2$-Arg-Xaa$_4$-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:629)

f622) RHN-Lys-Pro-Val-Ser-Leu-Ser-Tyr-Arg-Xaa$_1$-Pro-Xaa$_2$-Arg-Phe-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:630)

f623) RHN-Xaa$_3$-Pro-Val-Ser-Leu-Ser-Tyr-Arg-Xaa$_1$-Pro-Xaa$_2$-Arg-Phe-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:631)

f624) RHN-Lys-Xaa$_3$-Val-Ser-Leu-Ser-Tyr-Arg-Xaa$_1$-Pro-Xaa$_2$-Arg-Phe-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:632)

f625) RHN-Lys-Pro-Xaa$_3$-Ser-Leu-Ser-Tyr-Arg-Xaa$_1$-Pro-Xaa$_2$-Arg-Phe-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:633)

f626) RHN-Lys-Pro-Val-Xaa$_3$-Leu-Ser-Tyr-Arg-Xaa$_1$-Pro-Xaa$_2$-Arg-Phe-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:634)

f627) RHN-Lys-Pro-Val-Ser-Xaa$_3$-Ser-Tyr-Arg-Xaa$_1$-Pro-Xaa$_2$-Arg-Phe-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:635)

f628) RHN-Lys-Pro-Val-Ser-Leu-Xaa$_3$-Tyr-Arg-Xaa$_1$-Pro-Xaa$_2$-Arg-Phe-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:636)

f629) RHN-Lys-Pro-Val-Ser-Leu-Ser-Xaa$_3$-Arg-Xaa$_1$-Pro-Xaa$_2$-Arg-Phe-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:637)

f630) RHN-Lys-Pro-Val-Ser-Leu-Ser-Tyr-Xaa$_3$-Xaa$_1$-Pro-Xaa$_2$-Arg-Phe-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:638)

SDF-1 (1-17)[linker]-MIP-1α (55-69)cyclic(Lys61-Asp64) acid or amide f631) RHN-Lys-Pro-Val-Ser-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:639)

f632) RHN-Xaa$_3$-Pro-Val-Ser-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:640)

f633) RHN-Lys-Xaa$_3$-Val-Ser-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:641)

f634) RHN-Lys-Pro-Xaa$_3$-Ser-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:642)

f635) RHN-Lys-Pro-Val-Xaa$_3$-Leu-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:643)

f636) RHN-Lys-Pro-Val-Ser-Xaa$_3$-Ser-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:644)

f637) RHN-Lys-Pro-Val-Ser-Leu-Xaa$_3$-Tyr-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:645)

f638) RHN-Lys-Pro-Val-Ser-Leu-Ser-Xaa$_3$-Arg-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:646)

f639) RHN-Lys-Pro-Val-Ser-Leu-Ser-Tyr-Xaa$_3$-Xaa$_1$-Pro-Xaa$_2$-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:647)

f640) RHN-Lys-Pro-Val-Ser-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:648)

f641) RHN-Xaa$_3$-Pro-Val-Ser-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:649)

f642) RHN-Lys-Xaa$_3$-Val-Ser-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:650)

f643) RHN-Lys-Pro-Xaa$_3$-Ser-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:651)

f644) RHN-Lys-Pro-Val-Xaa$_3$-Leu-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:652)

f645) RHN-Lys-Pro-Val-Ser-Xaa$_3$-Ser-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:653)

f646) RHN-Lys-Pro-Val-Ser-Leu-Xaa$_3$-Tyr-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:654)

f647) RHN-Lys-Pro-Val-Ser-Leu-Ser-Xaa$_3$-Arg-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ D NO:655)

f648) RHN-Lys-Pro-Val-Ser-Leu-Ser-Tyr-Xaa$_3$-Xaa$_1$-Pro-Xaa$_2$-Xaa$_4$-Phe-Phe-Glu-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:656)

f649) RHN-Lys-Pro-Val-Ser-Leu-Ser-Tyr-Arg-Xaa$_1$-Pro-Xaa$_2$-Arg-Xaa$_4$-Phe-Glu-Ser-His-[linker]-Glu-Glu-Trpf650) RHN-Xaa₃-Pro-Val-Ser-Leu-Ser-Tyr-Arg-Xaa₁-Pro-
Xaa₂-Arg-Xaa₄-Phe-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:658)

f651) RHN-Lys-Xaa₃-Val-Ser-Leu-Ser-Tyr-Arg-Xaa₁-Pro-
Xaa₂-Arg-Xaa₄-Phe-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:659)

f652) RHN-Lys-Pro-Xaa₃-Ser-Leu-Ser-Tyr-Arg-Xaa₁-Pro-
Xaa₂-Arg-Xaa₄-Phe-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:660)

f653) RHN-Lys-Pro-Val-Xaa₃-Leu-Ser-Tyr-Arg-Xaa₁-Pro-
Xaa₂-Arg-Xaa₄-Phe-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:661)

f654) RHN-Lys-Pro-Val-Ser-Xaa₃-Ser-Tyr-Arg-Xaa₁-Pro-
Xaa₂-Arg-Xaa₄-Phe-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:662)

f655) RHN-Lys-Pro-Val-Ser-Leu-Xaa₃-Tyr-Arg-Xaa₁-Pro-
Xaa₂-Arg-Xaa₄-Phe-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:663)

f656) RHN-Lys-Pro-Val-Ser-Leu-Ser-Xaa₃-Arg-Xaa₁-Pro-
Xaa₂-Arg-Xaa₄-Phe-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:664)

f657) RHN-Lys-Pro-Val-Ser-Leu-Ser-Tyr-Xaa₃-Xaa₁-Pro-
Xaa₂-Arg-Xaa₄-Phe-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:665)

f658) RHN-Lys-Pro-Val-Ser-Leu-Ser-Tyr-Arg-Xaa₁-Pro-
Xaa₂-Arg-Phe-Xaa₄-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:666)

f659) RHN-Xaa₃-Pro-Val-Ser-Leu-Ser-Tyr-Arg-Xaa₁-Pro-
Xaa₂-Arg-Phe-Xaa₄-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:667)

f660) RHN-Lys-Xaa₃-Val-Ser-Leu-Ser-Tyr-Arg-Xaa₁-Pro-
Xaa₂-Arg-Phe-Xaa₄-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:668)

f661) RHN-Lys-Pro-Xaa₃-Ser-Leu-Ser-Tyr-Arg-Xaa₁-Pro-
Xaa₂-Arg-Phe-Xaa₄-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:669)

f662) RHN-Lys-Pro-Val-Xaa₃-Leu-Ser-Tyr-Arg-Xaa₁-Pro-
Xaa₂-Arg-Phe-Xaa₄-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:670)

f663) RHN-Lys-Pro-Val-Ser-Xaa₃-Ser-Tyr-Arg-Xaa₁-Pro-
Xaa₂-Arg-Phe-Xaa₄-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:671)

f664) RHN-Lys-Pro-Val-Ser-Leu-Xaa₃-Tyr-Arg-Xaa₁-Pro-
Xaa₂-Arg-Phe-Xaa₄-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:672)

f665) RHN-Lys-Pro-Val-Ser-Leu-Ser-Xaa₃-Arg-Xaa₁-Pro-
Xaa₂-Arg-Phe-Xaa₄-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:673)

f666) RHN-Lys-Pro-Val-Ser-Leu-Ser-Tyr-Xaa₃-Xaa₁-Pro-
Xaa₂-Arg-Phe-Xaa₄-Glu-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:674)

f667) RHN-Lys-Pro-Val-Ser-Leu-Ser-Tyr-Arg-Xaa₁-Pro-
Xaa₂-Arg-Phe-Phe-Xaa₄-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:675)

f668) RHN-Xaa₃-Pro-Val-Ser-Leu-Ser-Tyr-Arg-Xaa₁-Pro-
Xaa₂-Arg-Phe-Phe-Xaa₄-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:676)

f669) RHN-Lys-Xaa₃-Val-Ser-Leu-Ser-Tyr-Arg-Xaa₁-Pro-
Xaa₂-Arg-Phe-Phe-Xaa₄-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:677)

f670) RHN-Lys-Pro-Xaa₃-Ser-Leu-Ser-Tyr-Arg-Xaa₁-Pro-
Xaa₂-Arg-Phe-Phe-Xaa₄-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:678)

f671) RHN-Lys-Pro-Val-Xaa₃-Leu-Ser-Tyr-Arg-Xaa₁-Pro-
Xaa₂-Arg-Phe-Phe-Xaa₄-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:679)

f672) RHN-Lys-Pro-Val-Ser-Xaa₃-Ser-Tyr-Arg-Xaa₁-Pro-
Xaa₂-Arg-Phe-Phe-Xaa₄-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:680)

f673) RHN-Lys-Pro-Val-Ser-Leu-Xaa₃-Tyr-Arg-Xaa₁-Pro-
Xaa₂-Arg-Phe-Phe-Xaa₄-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:681)

f674) RHN-Lys-Pro-Val-Ser-Leu-Ser-Xaa₃-Arg-Xaa₁-Pro-
Xaa₂-Arg-Phe-Phe-Xaa₄-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:682)

f675) RHN-Lys-Pro-Val-Ser-Leu-Ser-Tyr-Xaa₃-Xaa₁-Pro-
Xaa₂-Arg-Phe-Phe-Xaa₄-Ser-His-[linker]-Glu-Glu-Trp-
Val-Gln-Lys-Tyr-Val-Asp-
Asp-Leu-Glu-Leu-Ser-Ala-(OH)NH₂ (SEQ ID NO:683)

f676) RHN-Lys-Pro-Val-Ser-Leu-Ser-Tyr-Arg-Xaa₁-Pro-
Xaa₂-Arg-Phe-Phe-Glu-Xaa₄-His-[linker]-Glu-Glu-Trp-
Val-Gln-Lys-Tyr-Val-Asp-
Asp-Leu-Glu-Leu-Ser-Ala-(OH)NH₂ (SEQ ID NO:684)

f677) RHN-Xaa₃-Pro-Val-Ser-Leu-Ser-Tyr-Arg-Xaa₁-Pro-
Xaa₂-Arg-Phe-Phe-Glu-Xaa₄-His-[linker]-Glu-Glu-Trp-
Val-Gln-Lys-Tyr-Val-Asp-
Asp-Leu-Glu-Leu-Ser-Ala-(OH)NH₂ (SEQ ID NO:685)

f678) RHN-Lys-Xaa3-Val-Ser-Leu-Ser-Tyr-Arg-Xaa1-Pro-
Xaa2-Arg-Phe-Phe-Glu-Xaa4His-[linker]-Glu-Glu-Trp-
Val-Gln-Lys-Tyr-Val-Asp-
Asp-Leu-Glu-Leu-Ser-Ala-(OH)NH₂ (SEQ ID NO:686)

f679) RHN-Lys-Pro-Xaa₃-Ser-Leu-Ser-Tyr-Arg-Xaa₁-Pro-
Xaa₂-Arg-Phe-Phe-Glu-Xaa₄-His-[linker]-Glu-Glu-Trp-
Val-Gln-Lys-Tyr-Val-Asp-
Asp-Leu-Glu-Leu-Ser-Ala-(OH)NH₂ (SEQ ID NO:687)

f680) RHN-Lys-Pro-Val-Xaa₃-Leu-Ser-Tyr-Arg-Xaa₁-Pro-
Xaa₂-Arg-Phe-Phe-Glu-Xaa₄-His-[linker]-Glu-Glu-Trp-
Val-Gln-Lys-Tyr-Val-Asp-
Asp-Leu-Glu-Leu-Ser-Ala-(OH)NH₂ (SEQ ID NO:688)

f681) RHN-Lys-Pro-Val-Ser-Xaa₃-Ser-Tyr-Arg-Xaa₁-Pro-
Xaa₂-Arg-Phe-Phe-Glu-Xaa₄-His-[linker]-Glu-Glu-Trp-
Val-Gln-Lys-Tyr-Val-Asp-
Asp-Leu-Glu-Leu-Ser-Ala-(OH)NH₂ (SEQ ID NO:689)

f682) RHN-Lys-Pro-Val-Ser-Leu-Xaa₃-Tyr-Arg-Xaa₁-Pro-
Xaa₂-Arg-Phe-Phe-Glu-Xaa₄-His-[linker]-Glu-Glu-Trpf683) RHN-Lys-Pro-Val-Ser-Leu-Ser-Xaa$_3$-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:691)

f684) RHN-Lys-Pro-Val-Ser-Leu-Ser-Tyr-Xaa$_3$-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:692)

f685) RHN-Lys-Pro-Val-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:693)

f686) RHN-Xaa$_3$-Pro-Val-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:694)

f687) RHN-Lys-Xaa$_3$-Val-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:695)

f688) RHN-Lys-Pro-Xaa$_3$-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:696)

f689) RHN-Lys-Pro-Val-Xaa$_3$-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:697)

f690) RHN-Lys-Pro-Val-Ser-Xaa$_3$-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:698)

f691) RHN-Lys-Pro-Val-Ser-Leu-Xaa$_3$-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:699)

f692) RHN-Lys-Pro-Val-Ser-Leu-Ser-Xaa$_3$-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:700)

f693) RHN-Lys-Pro-Val-Ser-Leu-Ser-Tyr-Xaa$_3$-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:701)

SDF-(1-14)-[linker]-MIP-11α (55-69)cyclic(Glu57-Lys611) acid or amide f694) RHN-Lys-Pro-Val-Ser-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:702)

f695) RHN-Xaa$_3$-Pro-Val-Ser-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:703)

f696) RHN-Lys-Xaa$_3$-Val-Ser-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:704)

f697) RHN-Lys-Pro-Xaa$_3$-Ser-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:705)

f698) RHN-Lys-Pro-Val-Xaa$_3$-Leu-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:706)

f699) RHN-Lys-Pro-Val-Ser-Xaa$_3$-Ser-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:707)

f700) RHN-Lys-Pro-Val-Ser-Leu-Xaa$_3$-Tyr-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:708)

f701) RHN-Lys-Pro-Val-Ser-Leu-Ser-Xaa$_3$-Arg-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:709)

f702) RHN-Lys-Pro-Val-Ser-Leu-Ser-Tyr-Xaa$_3$-Xaa$_1$-Pro-Xaa$_2$-Arg-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:710)

f703) RHN-Lys-Pro-Val-Ser-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:711)

f705) RHN-Xaa$_3$-Pro-Val-Ser-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:712)

f706) RHN-Lys-Xaa$_3$-Val-Ser-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:713)

f707) RHN-Lys-Pro-Xaa$_3$-Ser-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:714)

f708) RHN-Lys-Pro-Val-Xaa$_3$-Leu-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:715)

f709) RHN-Lys-Pro-Val-Ser-Xaa$_3$-Ser-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:716)

f710) RHN-Lys-Pro-Val-Ser-Leu-Xaa$_3$-Tyr-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:717)

f712) RHN-Lys-Pro-Val-Ser-Leu-Ser-Xaa$_3$-Arg-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:718)

f713) RHN-Lys-Pro-Val-Ser-Leu-Ser-Tyr-Xaa$_3$-Xaa$_1$-Pro-Xaa$_2$-Xaa$_4$-Phe-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:719)

714) RHN-Lys-Pro-Val-Ser-Leu-Ser-Tyr-Arg-Xaa$_1$-Pro-Xaa$_2$-Arg-Xaa$_4$-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:720)

f715) RHN-Xaa$_3$-Pro-Val-Ser-Leu-Ser-Tyr-Arg-Xaa$_1$-Pro-Xaa$_2$-Arg-Xaa$_4$-Phe-[linker]-Glu-Glu-Trp-Val-Gln-Lys-Tyr-Val-Asp-Asp-Leu-Glu-Leu-Ser-Ala-(OH)NH$_2$ (SEQ ID NO:721)

f716) RHN-Lys-Xaa₃-Val-Ser-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:722)

f717) RHN-Lys-Pro-Xaa₃-Ser-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:723)

718) RHN-Lys-Pro-Val-Xaa₃-Leu-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:724)

f719) RHN-Lys-Pro-Val-Ser-Xaa₃-Ser-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:725)

f720) RHN-Lys-Pro-Val-Ser-Leu-Xaa₃-Tyr-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:726)

f721) RHN-Lys-Pro-Val-Ser-Leu-Ser-Xaa₃-Arg-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:727)

f722) RHN-Lys-Pro-Val-Ser-Leu-Ser-Tyr-Xaa₃-Xaa₁-Pro-Xaa₂-Arg-Xaa₄-Phe-[linker]-Glu-Glu-Trp-Val-Gln-Lys-Tyr-Val-Asp-Asp-Leu-Glu-Leu-Ser-Ala-(OH)NH₂ (SEQ ID NO:728)

f723) RHN-Lys-Pro-Val-Ser-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:729)

f724) RHN-Xaa₃-Pro-Val-Ser-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:730)

f725) RHN-Lys-Xaa₃-Val-Ser-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₁₂ (SEQ ID NO:731)

f726) RHN-Lys-Pro-Xaa₃-Ser-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:732)

f727) RHN-Lys-Pro-Val-Xaa₃-Leu-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₁₂ (SEQ ID NO:733)

f728) RHN-Lys-Pro-Val-Ser-Xaa₃-Ser-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:734)

f729) RHN-Lys-Pro-Val-Ser-Leu-Xaa₃-Tyr-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:735)

f730) RHN-Lys-Pro-Val-Ser-Leu-Ser-Xaa₃-Arg-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₁₂ (SEQ ID NO:736)

f731) RHN-Lys-Pro-Val-Ser-Leu-Ser-Tyr-Xaa₃-Xaa₁-Pro-Xaa₂-Arg-Phe-Xaa₄-[linker]-Glu-Glu-Trp-Val-Gln-Lys-Tyr-Val-Asp-Asp-Leu-Glu-Leu-Ser-Ala-(OH)NH₂ (SEQ ID NO:737)

SDF-1 (1-17)-[linker]-MIP-11α (55-69)-cyclic(Glu57-Lys61) acid or amide f732) RHN-Lys-Pro-Val-Ser-Leu-Ser-Tyr-Arg-Xaa₁-Pro-Xaa₂-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:738)

f733) RHN-Xaa₃-Pro-Val-Ser-Leu-Ser-Tyr-Arg-Xaa₁-Pro-Xaa₂-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:739)

f734) RHN-Lys-Xaa₃-Val-Ser-Leu-Ser-Tyr-Arg-Xaa₁-Pro-Xaa₂-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:740)

f735) RHN-Lys-Pro-Xaa₃-Ser-Leu-Ser-Tyr-Arg-Xaa₁-Pro-Xaa₂-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:741)

f736) RHN-Lys-Pro-Val-Xaa₃-Leu-Ser-Tyr-Arg-Xaa₁-Pro-Xaa₂-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:742)

f737) RHN-Lys-Pro-Val-Ser-Xaa₃-Ser-Tyr-Arg-Xaa₁-Pro-Xaa₂-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:743)

f738) RHN-Lys-Pro-Val-Ser-Leu-Xaa₃-Tyr-Arg-Xaa₁-Pro-Xaa₂-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NR₂ (SEQ ID NO:744)

f739) RHN-Lys-Pro-Val-Ser-Leu-Ser-Xaa₃-Arg-Xaa₁-Pro-Xaa₂-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:745)

f740) RHN-Lys-Pro-Val-Ser-Leu-Ser-Tyr-Xaa₃-Xaa₁-Pro-Xaa₂-Arg-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:746)

f741) RHN-Lys-Pro-Val-Ser-Leu-Ser-Tyr-Arg-Xaa₁-Pro-Xaa₂-Xaa₄-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:747)

f742) RHN-Xaa₃-Pro-Val-Ser-Leu-Ser-Tyr-Arg-Xaa₁-Pro-Xaa₂-Xaa₄-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:748)

f743) RHN-Lys-Xaa₃-Val-Ser-Leu-Ser-Tyr-Arg-Xaa₁-Pro-Xaa₂-Xaa₄-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:749)

f744) RHN-Lys-Pro-Xaa₃-Ser-Leu-Ser-Tyr-Arg-Xaa₁-Pro-Xaa₂-Xaa₄-Phe-Phe-Glu-Ser-His-[linker]-Glu-Glu-Trp-Val-Gln-Lys-Tyr-Val-Asp-Asp-Leu-Glu-Leu-Ser-Ala-(OH)NH₂ (SEQ ID NO:750)

f745) RHN-Lys-Pro-Val-Xaa₃-Leu-Ser-Tyr-Arg-Xaa₁-Pro-Xaa₂-Xaa₄-Phe-Phe-Glu-Ser-His-[linker]-Gluf746) RHN-Lys-Pro-Val-Ser-Xaa₃-Ser-Tyr-Arg-Xaa₁-Pro-
Xaa₂-Xaa₄-Phe-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:752)

f747) RHN-Lys-Pro-Val-Ser-Leu-Xaa₃-Tyr-Arg-Xaa₁-Pro-
Xaa₂-Xaa₄-Phe-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:753)

f748) RHN-Lys-Pro-Val-Ser-Leu-Ser-Xaa₃-Arg-Xaa₁-Pro-
Xaa₂-Xaa₄-Phe-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:754)

f749) RHN-Lys-Pro-Val-Ser-Leu-Ser-Tyr-Xaa₃-Xaa₁-Pro-
Xaa₂-Xaa₄-Phe-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:755)

f750) RHN-Lys-Pro-Val-Ser-Leu-Ser-Tyr-Arg-Xaa₁-Pro-
Xaa₂-Arg-Xaa₄-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:756)

f751) RHN-Xaa₃-Pro-Val-Ser-Leu-Ser-Tyr-Arg-Xaa₁-Pro-
Xaa₂-Arg-Xaa₄-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:757)

f752) RHN-Lys-Xaa₃-Val-Ser-Leu-Ser-Tyr-Arg-Xaa₁-Pro-
Xaa₂-Arg-Xaa₄-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:758)

f753) RHN-Lys-Pro-Xaa₃-Ser-Leu-Ser-Tyr-Arg-Xaa₁-Pro-
Xaa₂-Arg-Xaa₄-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:759)

f754) RHN-Lys-Pro-Val-Xaa₃-Leu-Ser-Tyr-Arg-Xaa₁-Pro-
Xaa₂-Arg-Xaa₄-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:760)

f755) RHN-Lys-Pro-Val-Ser-Xaa₃-Ser-Tyr-Arg-Xaa₁-Pro-
Xaa₂-Arg-Xaa₄-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:761)

f756) RHN-Lys-Pro-Val-Ser-Leu-Xaa₃-Tyr-Arg-Xaa₁-Pro-
Xaa₂-Arg-Xaa₄-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:762)

f757) RHN-Lys-Pro-Val-Ser-Leu-Ser-Xaa₃-Arg-Xaa₁-Pro-
Xaa₂-Arg-Xaa₄-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:763)

f758) RHN-Lys-Pro-Val-Ser-Leu-Ser-Tyr-Xaa₃-Xaa₁-Pro-
Xaa₂-Arg-Xaa₄-Phe-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:764)

f759) RHN-Lys-Pro-Val-Ser-Leu-Ser-Tyr-Arg-Xaa₁-Pro-
Xaa₂-Arg-Phe-Xaa₄-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:765)

f760) RHN-Xaa₃-Pro-Val-Ser-Leu-Ser-Tyr-Arg-Xaa₁-Pro-
Xaa₂-Arg-Phe-Xaa₄-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:766)

f761) RHN-Lys-Xaa₃-Val-Ser-Leu-Ser-Tyr-Arg-Xaa₁-Pro-
Xaa₂-Arg-Phe-Xaa₄-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:767)

f762) RHN-Lys-Pro-Xaa₃-Ser-Leu-Ser-Tyr-Arg-Xaa₁-Pro-
Xaa₂-Arg-Phe-Xaa₄-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:768)

f763) RHN-Lys-Pro-Val-Xaa₃-Leu-Ser-Tyr-Arg-Xaa₁-Pro-
Xaa₂-Arg-Phe-Xaa₄-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:769)

f764) RHN-Lys-Pro-Val-Ser-Xaa₃-Ser-Tyr-Arg-Xaa₁-Pro-
Xaa₂-Arg-Phe-Xaa₄-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:770)

f765) RHN-Lys-Pro-Val-Ser-Leu-Xaa₃-Tyr-Arg-Xaa₁-Pro-
Xaa₂-Arg-Phe-Xaa₄-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:771)

f766) RHN-Lys-Pro-Val-Ser-Leu-Ser-Xaa₃-Arg-Xaa₁-Pro-
Xaa₂-Arg-Phe-Xaa₄-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:772)

f767) RHN-Lys-Pro-Val-Ser-Leu-Ser-Tyr-Xaa₃-Xaa₁-Pro-
Xaa₂-Arg-Phe-Xaa₄-Glu-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:773)

f768) RHN-Lys-Pro-Val-Ser-Leu-Ser-Tyr-Arg-Xaa₁-Pro-
Xaa₂-Arg-Phe-Phe-Xaa₄-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:774)

f769) RHN-Xaa₃-Pro-Val-Ser-Leu-Ser-Tyr-Arg-Xaa₁-Pro-
Xaa₂-Arg-Phe-Phe-Xaa₄-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:775)

f770) RHN-Lys-Xaa₃-Val-Ser-Leu-Ser-Tyr-Arg-Xaa₁-Pro-
Xaa₂-Arg-Phe-Phe-Xaa₄-Ser-His-[linker]-Glu-
Glu-Trp-Val-Gln-
Lys-Tyr-Val-Asp-Asp-Leu-Glu-Leu-Ser-Ala-(OH)NH₂
(SEQ ID NO:776)

f771) RHN-Lys-Pro-Xaa₃-Ser-Leu-Ser-Tyr-Arg-Xaa₁-Pro-
Xaa₂-Arg-Phe-Phe-Xaa₄-Ser-His-[linker]-Gluf772) RHN-Lys-Pro-Val-Xaa$_3$-Leu-Ser-Tyr-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:778)

f773) RHN-Lys-Pro-Val-Ser-Xaa$_3$-Ser-Tyr-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:779)

f774) RHN-Lys-Pro-Val-Ser-Leu-Xaa$_3$-Tyr-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:780)

f775) RHN-Lys-Pro-Val-Ser-Leu-Ser-Xaa$_3$-Arg-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:781)

f776) RHN-Lys-Pro-Val-Ser-Leu-Ser-Tyr-Xaa$_3$-Xaa$_1$-Pro-Xaa$_2$-Arg-Phe-Phe-Xaa$_4$-Ser-His-[linker]-Glu-Glu-Trp-Val-Gln-Lys-Tyr-Val-Asp-Asp-Leu-Glu-Leu-Ser-Ala-(OH)NH$_2$ (SEQ ID NO:782)

f777) RHN-Lys-Pro-Val-Ser-Leu-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:783)

f778) RHN-Xaa$_3$-Pro-Val-Ser-Leu-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:784)

f779) RHN-Lys-Xaa$_3$-Val-Ser-Leu-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:785)

f780) RHN-Lys-Pro-Xaa$_3$-Ser-Leu-Ser-Tyr-Arg-Xaa$_1$-Pro-Xaa$_2$-Arg-Phe-Phe-Glu-Xaa$_{41}$-His-[linker]-Glu-Glu-Trp-Val-Gln-Lys-Tyr-Val-Asp-Asp-Leu-Glu-Leu-Ser-Ala-(OH)NH$_2$ (SEQ ID NO:786)

f781) RHN-Lys-Pro-Val-Xaa$_3$-Leu-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:787)

f782) RHN-Lys-Pro-Val-Xaa$_3$-Ser-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:788)

f783) RHN-Lys-Pro-Val-Ser-Leu-Xaa$_3$-Tyr-Arg-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:789)

f784) RHN-Lys-Pro-Val-Ser-Leu-Ser-Xaa$_3$-Arg-Xaa$_1$-Pro-Xaa$_2$-Arg-Phe-Phe-Glu-Xaa$_4$-His-[linker]-Glu-Trp-Val-Gln-Lys-Tyr-Val-Asp-Asp-Leu-Glu-Leu-Ser-Ala-(OH)NH$_2$ (SEQ ID NO:790)

f785) RHN-Lys-Pro-Val-Ser-Leu-Ser-Tyr-Xaa$_3$-Xaa$_1$-Pro-Xaa$_2$-Arg-Phe-Phe-Glu-Xaa$_4$-His-[linker]-Glu-Glu-Trp-Val-Gln-Lys-Tyr-Val-Asp-Asp-Leu-Glu-Leu-Ser-Ala-(OH)NH$_2$ (SEQ ID NO:791)

f786) RHN-Lys-Pro-Val-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:792)

f787) RHN-Xaa$_3$-Pro-Val-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:793)

f788) RHN-Lys-Xaa$_3$-Val-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:794)

f789) RHN-Lys-Pro-Xaa$_3$-Ser-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:795)

f790) RHN-Lys-Pro-Val-Xaa$_3$-Leu-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:796)

f791) RHN-Lys-Pro-Val-Ser-Xaa$_3$-Ser-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:797)

f792) RHN-Lys-Pro-Val-Ser-Leu-Xaa$_3$-Tyr-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:798)

f793) RHN-Lys-Pro-Val-Ser-Leu-Ser-Xaa$_3$-Arg-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:799)

f794) RHN-Lys-Pro-Val-Ser-Leu-Ser-Tyr-Xaa$_3$-Xaa$_1$-Pro-Xaa$_2$-Arg-Phe-Phe-Glu-Ser-Xaa$_4$-[linker]-Glu-Glu-Trp-Val-Gln-Lys-Tyr-Val-Asp-Asp-Leu-Glu-Leu-Ser-Ala-(OH)NH$_2$ (SEQ ID NO:800)

In the above sequences:

R is selected from the group consisting of hydrogen, alkyl, alkenyl, alkynyl, alkylcarbonyl, arylcarbonyl, aryl, PEG (polyethyleneglycol) and any other modifying group.

Xaa$_3$ is selected from the group consisting of L-Pro, D-Pro, P*, Btd and any L- or D-natural and non-natural amino acid.

Xaa$_4$ is selected from the group consisting of P*, Btd and any L- or D-natural amino acid and any non-natural amino acid.

P* is:

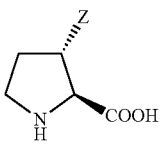

with Z = Ar, Ar—OH, alkyl and more

Z may be hydrogen, alkyl alkenyl, alkynyl, alkylcarbonyl, arylcarbonyl, aryl, or aryl-hydroxy.

A wide variety of amino acid substitutions may be made in polypeptide sequences, such as lysine to glutamic acid, lysine to aspartic acid, glutamic acid (Glu) to ornithine (Orn), aspartic acid (Asp) to ornithine (Orn). Moieties other than naturally occurring amino acids may also be substituted, such as Btd: Btd* is:

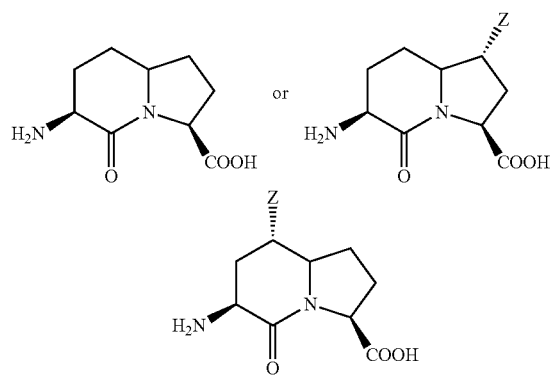

Z = Alkyl, Ar, Ar—OH and more

Z may be hydrogen, alkyl alkenyl, alkynyl, alkylcarbonyl, arylcarbonyl, aryl, or aryl-hydroxy.

$Xaa_1$ is selected from the group consisting of any L- or D-natural amino acid and any non-natural amino acid.

$Xaa_2$ is selected from the group consisting of any L- or D-natural amino acid and any non-natural amino acid.

The [linker] is a bifunctional group covalently attached to the N-terminal and C-terminal portions of the analog having the structure: $H_2N—Z_A—COOH$ wherein $Z_A$ is selected from the group consisting of: (1) alkyl, alkenyl, aralkyl, alkynyl; (2)-$(CH_2)_n$— wherein n is an integer n=9 to 14; (3) any combination of 4 natural amino acids or non-natural amino acids; and (4)-$(Gly)_4$-.

Compositions

The invention further provides pharmaceutical compositions containing chemokine receptor agonists or antagonists. In one embodiment, such compositions include a chemokine analog compound in a therapeutically, prophylactically, or diagnostically effective amount sufficient to be used in treating diseases or disorders selected from the group consisting of autoimmune diseases, acute chronic inflammation, cancer, cardiovascular disease, infectious disease, and inflammatory disorders including rheumatoid arthritis, chronic inflammatory bowel disease, chronic inflammatory pelvic disease, multiple sclerosis, asthma, osteoarthritis, atherosclerosis, psoriasis, rhinitis, autoimmunity, and organ transplant rejection. In another embodiment, such compositions include a chemokine analog compound in a therapeutically or prophylactically effective amount sufficient to be used to increase the hemocrit, assist in mobilizing and recovering stem cells, stimulate the production of blood cells, or assist in vaccine production.

An "effective amount" of a compound of the invention includes a therapeutically effective amount or a prophylactically effective amount. A "therapeutically effective amount" refers to an amount effective, at dosages and for periods of time necessary, to achieve the desired therapeutic result. The term "therapeutically effective amount" may also refer to that amount of active compound, prodrug or pharmaceutical agent that elicits a biological or medicinal response in a tissue, system, animal or human that is being sought by a researcher, veterinarian, medical doctor or other clinician in order to provide a therapeutic effect.

A "prophylactically effective amount" refers to an amount effective, at dosages and for periods of time necessary, to achieve the desired prophylactic result, such as preventing or inhibiting a cytotoxic effect of a cytotoxic agent. Typically, a prophylactic dose is used in subjects prior to or at an earlier stage of disease, so that a prophylactically effective amount may be less than a therapeutically effective amount. The term "preventing" refers to decreasing the probability that an organism contracts or develops an abnormal condition.

In particular embodiments, a preferred range for therapeutically or prophylactically effective amounts of chemokine analogs may be 0.1 nM-0.1M, 0.1 nM-0.05 M, 0.05 nM-15 µM or 0.01 nM-10 µM. It is to be noted that dosage values may vary with the severity of the condition to be alleviated. For any particular subject, specific dosage regimens may be adjusted over time according to the individual need and the professional judgement of the person administering or supervising the administration of the compositions. Dosage ranges set forth herein are exemplary only and do not limit the dosage ranges that may be selected by medical practitioners.

The amount of active compound in the composition may vary according to factors such as the disease state, age, sex, and weight of the individual. Dosage regimens may be adjusted to provide the optimum therapeutic response. For example, a single bolus may be administered, several divided doses may be administered over time or the dose may be proportionally reduced or increased as indicated by the exigencies of the therapeutic situation. It may be advantageous to formulate parenteral compositions in dosage unit form for ease of administration and uniformity of dosage. "Dosage unit form" as used herein refers to physically discrete units suited as unitary dosages for subjects to be treated; each unit containing a predetermined quantity of active compound calculated to produce the desired therapeutic effect in association with the required pharmaceutical carrier. The specification for the dosage unit forms of the invention are dictated by and directly dependent on (a) the unique characteristics of the active compound and the particular therapeutic effect to be achieved, and (b) the limitations inherent in the art of compounding such an active compound for the treatment of sensitivity in individuals.

The terms "administration" or "administering" refer to a method of incorporating a compound into the cells or tissues of an animal, preferably a mammal, and still more preferably a human, in order to treat or prevent an abnormal condition. When the compound or prodrug of the invention is provided in combination with one or active agents, the terms "administration" or "administering" include sequential or concurrent introduction of the compound or prodrug with the other agent(s). For cells harbored within the organism, many techniques exist in the art to administer compounds, including (but not limited to) oral, injection, parenteral, dermal, and aerosol applications.

The term "therapeutic effect" refers to the inhibition or activation of factors causing or contributing to the abnormal condition (including a disease or disorder). A therapeutic effect relieves or prevents to some extent one or more of the symptoms of the abnormal condition. In reference to the treatment of abnormal conditions, a therapeutic effect can refer to one or more of the following: (a) an increase or decrease in the number of lymphocytic cells present at a specified location, (b) an increase or decrease in the ability of lymphocytic cells to migrate, (c) an increase or decrease of lymphocytic cells to respond to a stimulus, (d) an increase or decrease in the proliferation, growth, and/or differentiation of cells; (e) inhibition (i.e., slowing or stopping) or acceleration of cell death; (f) relieving to some extent one or more of the symptoms associated with an abnormal condition; (g) enhancing or inhibiting the function of the affected population of cells; (h) activating an enzyme activity present in cells associated with the abnormal condition; (i) inhibiting an enzyme activity present in cells associated with the abnormal condition; and (j) decreasing or arresting the progression of a cell through the cell cycle.

The term "abnormal condition" refers to a function in the cells or tissues of an organism that deviates from their normal functions in that organism and includes, but is not limited to, conditions commonly referred to as diseases or disorders. An abnormal condition can relate to cell proliferation, cell differentiation, cell survival, cell migration or movement, or the activities of enzymes within a cell. Diseases and disorders may include inflammatory disorders including rheumatoid arthritis, chronic inflammatory bowel disease, chronic inflammatory pelvic disease, multiple sclerosis, asthma, osteoarthritis, atherosclerosis, psoriasis, rhinitis, autoimmunity, organ transplant rejection, and genetic diseases.

As used herein "pharmaceutically acceptable carrier" or "excipient" includes any and all solvents, dispersion media, coatings, antibacterial and antifungal agents, isotonic and absorption delaying agents, and the like that are physiologically compatible. In one embodiment, the carrier is suitable for parenteral administration. Alternatively, the carrier can be suitable for intravenous, intraperitoneal, intramuscular, sublingual or oral administration. Pharmaceutically acceptable carriers include sterile aqueous solutions or dispersions and sterile powders for the extemporaneous preparation of sterile injectable solutions or dispersion. The use of such media and agents for pharmaceutically active substances is well known in the art. Except insofar as any conventional media or agent is incompatible with the active compound, use thereof in the pharmaceutical compositions of the invention is contemplated. Supplementary active compounds can also be incorporated into the compositions.

Pharmaceutical formulations for parenteral administration may include liposomes. Liposomes and emulsions are well known examples of delivery vehicles or carriers that are especially useful for hydrophobic drugs. Depending on biological stability of the therapeutic reagent, additional strategies for protein stabilization may be employed. Furthermore, one may administer the drug in a targeted drug delivery system, for example, in a liposome coated with target-specific antibody. The liposomes will bind to the target protein and be taken up selectively by the cell expressing the target protein.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, or sodium chloride in the composition. Prolonged absorption of the injectable compositions can be brought about by including in the composition an agent which delays absorption, for example, monostearate salts and gelatin. Moreover, the chemokine analogs may be administered in a time release formulation, for example in a composition which includes a slow release polymer. The active compounds can be prepared with carriers that will protect the compound against rapid release, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, polylactic acid and polylactic, polyglycolic copolymers (PLG). Many methods for the preparation of such formulations are patented or generally known to those skilled in the art.

Additionally, suspensions of the compounds of the invention may be prepared as appropriate oily suspensions for injection. Suitable lipophilic solvents or vehicles include fatty oils such as sesame oil; or synthetic fatty acid esters, such as ethyl oleate or triglycerides; or liposomes. Suspensions to be used for injection may also contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof. In accordance with an alternative aspect of the invention, a chemokine analog may be formulated with one or more additional compounds that enhance the solubility of the chemokine analog.

If the compounds of the invention are to be administered by inhalation, they may be conveniently delivered in the form of an aerosol spray presentation from pressurized packs or a nebuliser, together with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of gelatin, for example, for use in an inhaler may be formulated containing a powder mix of the compound and a suitable powder base such as starch or lactose.

The term "modulates" refers to altering the function or activity of a chemokine receptor by contacting it with a chemokine or chemokine analog and thus increasing or decreasing the probability that a complex forms between the receptor and a natural binding partner. A chemokine or chemokine analog preferably increases the probability that such a complex forms between the chemokine receptor and the natural binding partner, more preferably increases or decreases the probability that a complex forms between the chemokine receptor and the natural binding partner depending on the concentration of the chemokine or chemokine analog exposed to the receptor, and most preferably decreases the probability that a complex forms between the chemokine receptor and the natural binding partner depending on the concentration of the chemokine or chemokine analog exposed to the polypeptide.

The term "chemokine receptor" refers to a chemokine receptor as the term is used by one skilled in the art and also refers to any other polypeptide capable of binding a chemokine or chemokine analog.

In embodiments, a modulator preferably activates the catalytic activity of a chemokine receptor, more preferably activates or inhibits the catalytic activity of a chemokine receptor depending on the concentration of the chemokine or chemokine analog exposed to the chemokine receptor, or most preferably inhibits the catalytic activity of a chemokine receptor depending on the concentration of the chemokine or chemokine analog exposed to the chemokine receptor.

The term "natural binding partner" refers to G proteins, polypeptides, lipids, small molecules, or nucleic acids that bind to chemokine receptors in cells or in the extracellular environment. The term natural binding partner includes a substrate to be acted upon by the chemokine receptor. A change in the interaction between a chemokine receptor and a natural binding partner can manifest itself as an increased or decreased probability that the interaction forms, or an increased or decreased concentration of chemokine receptor/natural binding partner complex. This can result in a decreased or increased activity of the chemokine receptor.

The terms "activated," "activating," and "activation" refer to an increase in the cellular or extracellular function of a chemokine receptor. The chemokine receptor function is preferably the interaction with a natural binding partner, and most preferably catalytic activity. The term "inhibits" refers to decreasing the cellular or extracellular activity of the chemokine receptor. The cellular or extracellular activity of a chemokine receptor is preferably the interaction with a natural binding partner, and most preferably catalytic activity.

The term "complex" refers to an assembly of at least two molecules bound to one another. Signal transduction complexes often contain at least two protein molecules bound to one another. For instance, a protein tyrosine receptor protein kinase, GRB2, SOS, RAF, and RAS assemble to form a signal transduction complex in response to a mitogenic ligand. Another example is a chemokine bound to a chemokine receptor. Still another example is a G protein bound to a chemokine receptor.

The term "contacting" as used herein refers to mixing a solution comprising the chemokine or chemokine analog with a liquid medium bathing the polypeptide or cells comprising a chemokine receptor. The solution comprising the chemokine or chemokine analog may also comprise another component, such as dimethyl sulfoxide (DMSO), which facilitates the uptake of the chemokine or chemokine analog into the cells of the methods. The solution comprising the chemokine or chemokine analog may be added to the medium bathing the cells by utilizing a delivery apparatus, such as a pipette-based device or syringe-based device.

As discussed supra, compounds of the present invention may prove useful in increasing the hemocrit, mobilizing stem cells, or in assisting in vaccine production or otherwise stimulating the immune system to effectuate tumor destruction. SDF-1 has been shown to enhance platelet production (Lane et al., Blood 96:4152-59, 2000) and B-cell production (Nagasawa, T., Int. J. Hematol. 72:408-11, 2000), inter alia. Analogs of chemokines may also be useful in improving the engraftment of stem cells following transplantation (Nagasawa, 2000). Chemokine analogs of the invention may also prove useful in mobilizing stem cells (Gazitt, Y., J. Hematother Stem Cell Res 10:229-36, 2001; Hattori et al., Blood 97:3354-59, 2001). They may also prove useful in enhancing anti-tumor immunity (Nomura et al., Int. J. Cancer 91:597-606, 2001; Mach and Dranoff, Curr. Opin. Immunol. 12:571-75, 2000). Other aspects and roles of modulating chemokine function are reviewed in Schwarz and Wells (Schwarz and Wells, Nat. Rev. Drug Discov. 1:347-58, 2002). Chemokine analogs of the present invention may also prove useful in facilitating gene therapy. Glimm and colleagues reported that SDF-1 arrests hematopoietic stem cell cycling, thus allowing a better transfection of these cells with gene constructs for the purpose of gene therapy (Glimm H. et al., "Ex vivo treatment of proliferating human cord blood stem cells with stroma-derived factor-1 enhances their ability to engraft NOD/SCID mice," Blood 99(9):3454-57, 2002). All of the above references are incorporated by reference herein their entirety, including any drawings, tables, and figures.

EXAMPLES

The following examples illustrate, but do not limit, the present invention.

Example 1

Figure 1B:
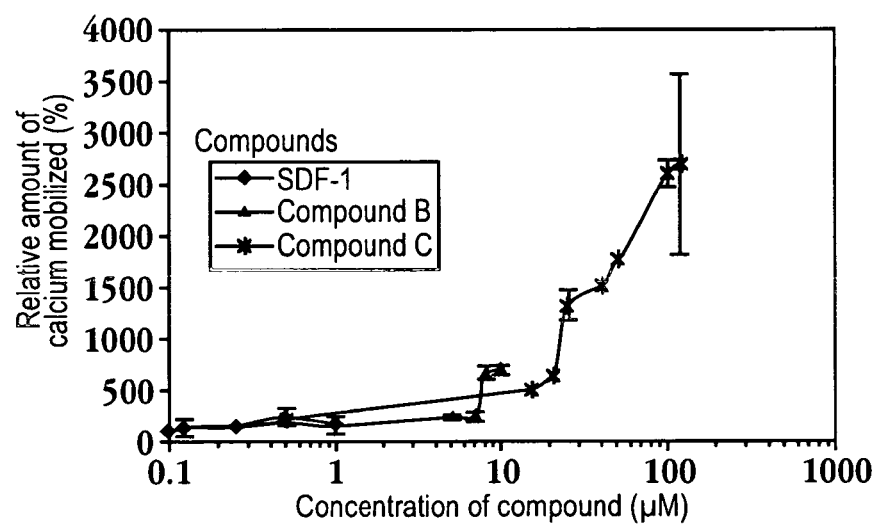

This example illustrates the efficacy of SDF-1 and SDF-1 peptide analogs in mediating intracellular calcium mobilization ($[Ca^{2+}]_i$). To illustrate that the binding of SDF-1 and SDF-1 peptide analogs results in the agonistic activation of the CXCR4 receptor, $[Ca^{2+}]_i$ mobilization assays were conducted, the results of which are shown in FIG. 1. Fluo-4,AM loaded SUP-T1 cells ($5\times10^6$ cells/ml), a human lymphoid cell line, were stimulated with SDF-1 and Compound A (SEQ ID NO:809), Compound B (SEQ ID NO:810), Compound C (SEQ ID NO:811), Compound D (SEQ ID NO:812) and Compound E (SEQ ID NO:813) at the concentrations indicated. The values represent the mean+/−one S.D. of a representative experiment from three independent experiments. As shown by the data in FIG. 1, incubation of SUP-T1 cells with SDF-1 or Compound A (SEQ ID NO:809), Compound B (SEQ ID NO:810), Compound C (SEQ ID NO:811), Compound D (SEQ ID NO:812) or Compound E (SEQ ID NO:813) resulted in the receptor-mediated induction of $[Ca^{2+}]_i$ mobilization. (The underlined residues in the structures depicted below were cyclized by a lactamization reaction between lysine and glutamic acid residues.)

Compound A or f400 (SEQ ID NO:405), wherein R=H, Xaa$_1$=Cys, Xaa$_2$=Cys, [linker]=4×Gly)
H$_2$N-Lys-Pro-Val-Ser-Leu-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH$_2$ (SEQ ID NO:809).

Compound B or f400 (SEQ ID NO:405), wherein R=H, Xaa$_1$=Ala, Xaa$_2$=Phe, [linker]=4×Gly)
H$_2$N-Lys-Pro-Val-Ser-Leu-Ser-Tyr-Arg-Ala-Pro-Phe-Arg-Phe-Phe-[Gly-Gly-Gly-Gly]-Leu-Lys-Trp-Ile-Gln-Glu-Tyr-Leu-Glu-Lys-Ala-Leu-Asn-NH$_2$ (SEQ ID NO:810).

Compound C or f400 (SEQ ID NO:405), wherein R=Ac, Xaa$_1$=Cys, Xaa$_2$=Cys, [linker]=4×Gly)
AcHN-Lys-Pro-Val-Ser-Leu-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH$_2$ (SEQ ID NO:811).

Compound D or f400 (SEQ ID NO:405), wherein R=Ac, Xaa₁=Cys, Xaa₂=Cys, [linker]=1 aminoundecanoic acid)
AcHN-Lys-Pro-Val-Ser-Leu-Ser-Tyr-Arg-Cys-Pro-Cys-Arg-Phe-Phe-[11 aminoundecanoic acid]-Leu-Lys-Trp-Ile-Gln-Glu-Tyr-Leu-Glu-Lys-Ala-Leu-Asn-NH₂ (SEQ ID NO:812).

Compound E or f401 (SEQ ID NO:406), wherein Xaa₃=desLys, Xaa=Cys, Xaa₂=Cys, [linker]=4×Gly) H₂N-[desNH₂ Lys]-Pro-Val-Ser-Leu-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH₂ (SEQ ID NO:813).

Compound F or f402 (SEQ ID NO:407), wherein Xaa₃=D-Pro, Xaa₁=Cys, Xaa₂=Cys, [linker]=4×Gly) H₂N-Lys-[D-Pro]-Val-Ser-Leu-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH₂ (SEQ ID NO:814).

Compound G or f405 (SEQ ID NO:410), wherein Xaa₃=D-Leu, Xaa₁=Cys, Xaa₂=Cys, [linker]=4×Gly) H₂N-Lys-Pro-Val-Ser-[D-Leu]-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH₂ (SEQ ID NO:815).

Compound H or f400 (SEQ ID NO:405), wherein R=H, Xaa₁=Cys, Xaa₂=Cys, [linker]=11aminoundecanoic acid H₂N-Lys-Pro-Val-Ser-Leu-Ser-Tyr-Arg-Cys-Pro-Cys-Arg-Phe-Phe-[11aminoundecanoic acid]-Leu-Lys-Trp-Ile-Gln-Glu-Tyr-Leu-Glu-Lys-Ala-Leu-Asn-NH₂ (SEQ ID NO:816).

The $[Ca^{2+}]_i$ mobilization assays were conducted as follows. Briefly, SUP-T1 cells (ATCC, Manassas, Va.), a human lymphoid cell line, were cultured in RPMI containing phenol red (Invitrogen, Burlington, Ontario, Canada) with 10% fetal bovine serum and antibiotics consisting of 100 U/ml penicillin G sodium and 100 μg/ml streptomycin sulfate (Invitrogen) at a density between $2\times10^5$ and $8\times10^5$ cells/ml. Cells were harvested and suspended in Tyrode's salt solution, consisting of 137 mM NaCl, 2.7 mM KCl, 1 mM $MgCl_2$, 1 mM $CaCl_2$, 0.2 mM $NaH_2PO_4$, 12 mM $NaHCO_3$, and 5.5 mM glucose, at $2\times10^6$ cells/ml then labeled with 4 μM Fluo-4/AM (Molecular Probes, Eugene, Oreg.) for 45 min at 37° C. Subsequently, cells were washed three times with Tyrode's salt solution, and resuspended at $5\times10^6$ cells/ml. SDF-1, Compound A (SEQ ID NO:809), Compound B (SEQ ID NO:810), Compound C (SEQ ID NO:811), Compound D (SEQ ID NO:812) or Compound E (SEQ ID NO:813) at the concentrations indicated were injected into aliquots of $5\times10^5$ cells. Changes in the level of cellular fluorescence were read in a Thermo Labsystems Fluorskan Acsent fluorescence plate reader (VWR, Mississauga, Ontario, Canada). Controls include cells treated with the recombinant chemokine or plain medium. Data is expressed with 100% being the level of fluorescence in plain medium. The values represent the mean+/−one S.D. of a representative experiment from three independent experiments. As shown by the data in FIG. 1, incubation of SUP-T1 cells with SDF-1, Compound A (SEQ ID NO:809), Compound B (SEQ ID NO:810), Compound C (SEQ ID NO:811), Compound D (SEQ ID NO:812) or Compound E (SEQ ID NO:813) resulted in the receptor-mediated induction of $[Ca^{2+}]_i$ mobilization.

Example 2

Figure 2:
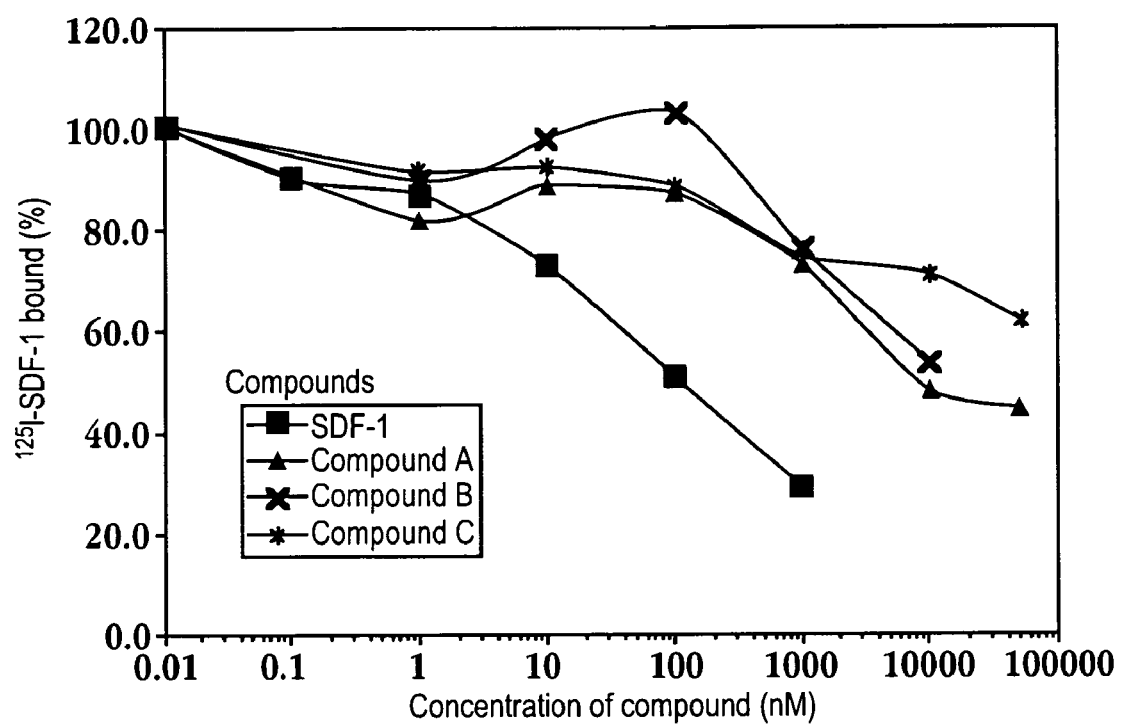
FIG. 2 shows the concentration-dependent inhibition of $^{125}$I-SDF-1 binding to CXCR4 by SDF-1, obtained as described, indicating the affinity of SDF-1 for the CXCR4 receptor on SUP-T1 cells, a human lymphoid cell line.

The efficacy of SDF-1 and SDF-1 peptide analogs as CXCR4 agonists was demonstrated through CXCR4 receptor binding assays. A competitive dose response for binding to the SDF-1 receptor by native SDF-1 and the CXCR4 agonists (competing ligands) against $^{125}$I-SDF-1 is shown in FIG. 2. Briefly, SUP-T1 cells were grown as in Example 1. Millipore MultiScreen plates with Durapore membrane (Millipore, Bedford, Mass.) were used for high throughput binding assays. The buffer used for the assay (binding buffer) consisted of 0.1% bovine albumin, 25 mM HEPES, 100 μg/ml chondroitin sulphate C, and 0.02% sodium azide in RPMI-1640. SUP-T1 cells were harvested, washed with plain RPMI and resuspended in binding buffer at $5\times10^6$ cells/ml. The Durapore membrane of the Millipore MultiScreen plates was moistened with blocking buffer containing 0.5% BSA (Sigma), 50 mM HEPES, 150 mM NaCl, 5 mM $MgCl_2$, 1 mM $CaCl_2$ and 0.02% sodium azide for 40 min before use. To the wells were added binding buffer, antagonist, the appropriate radiolabeled chemokine, and the appropriate cells. Cells were preincubated with peptide analogs for 30 min then incubated with $^{125}$I-SDF-1 for 2 h with shaking at 4° C. SDF-1 peptide analogs were used at concentrations indicated along with 0.5 nM radiolabeled SDF-1. After three washes with cold PBS, plates were dried and radioactivity counted using a Clini-Gamma gamma counter (LKB Wallac, Gaithersburg, Md.). Controls include wells with only binding buffer and radiolabeled chemokine for background, and wells with binding buffer, unlabelled chemokine standard, radiolabeled chemokine and cells for standardization. The results are expressed as percentages of the maximal specific binding that was determined without competing ligand, and are the representative results from three independent experiments. A concentration-dependent inhibition of $^{125}$I-SDF-1 is illustrated, indicating the affinity of SDF-1 and SDF-1 peptide analogs for the receptor. The inhibition of $^{125}$I-SDF-1 binding by SDF-1 and the SDF-1 analogs is indicative of CXCR4 receptor binding.

Example 3

Peptides of the invention may be synthesized chemically using the Fmoc/tBu strategy on a continuous flow peptide synthesizer, as for example has been carried out using the following protocols:
Reagents (Solvents, Support, Chemicals)
Main Solvent: N,N-Dimethylformamide (DMF): certified ACS spectroanalyzed from Fisher (D131-4) M.W.=73.10. The DMF is treated with activated molecular sieves, type 4A (from BDH: B54005) for at least two weeks then tested with FDNB (2,4-Dinitrofluorobenzene from Eastman).
Procedure: Mix equal volumes of FDNB solution (1 mg/ml in 95% ethanol) and DMF; Let stand 30 minutes; read the absorbance at 381 nm over a FDNB blank (0.5 ml FDNB+0.5 ml 95% EtOH). If the absorbance ~0.2, the DMF is suitable to be used for the synthesis.
Deblocking Agent: 20% Piperidine (from Aldrich Chemical company, catalog No: 10,409-4) in DMF containing 0.5% triton X100 v/v (from Sigma, catalog No: T-9284).
Activating Agents: 2-(H-benzotriazol-lyl) 1,1,3,3-tetramethyluronium tetrafluoroborate (TBTU: M.W.=321.09. from Quantum Richelieu, catalog No: R0139); Hydroxybenzotriazole (HOBt M.W.=135.1 from Quantum Richilieu, catalog No.: R0166-100) respectively, 0.52 M in DMF and 4-Methylmorpholine (NMM; M.W.=101.15, d=0.926 from Aldrich, catalog No.: M5,655-7): 0.9 M in DMF or in the case of sensitive amino acids to racemization such as cysteine, 2,4,6-Collidine, 99% (M.W.=121.18,d=0.917, from Aldrich, catalog No: 14,238-7) is used: 0.78M in DMF/DCM, 1/1 v/v.
Support: TentaGel R RAM (90 μm), RinK-type Fmoc (from Peptides International, catalog No.: RTS-9995-PI): 0.21 mmol/g, 0.5 g for 0.1 mmol of peptide.
Fmoc-L-amino derivative, side-chains were protected with: Boc; tBu; Trt groups: with 4 fold excess (from Peptides International, Bachem, Novabiochem, Chem-Impex Inc).

Glu24 and Lys20 of the compound represented by SEQ ID NO:809 were Allyl-protected (from Millipore/Perseptive Biosystems).

Initial Amino Loading and Peptide Synthesis Procedure

The first amino acid Asn31 and the remaining residues are double coupled at room temperature or at 45° C. automatically with 4-fold excess in each coupling. The synthesis is interrupted after residue Leu19, numbering consecutively in the compound represented by SEQ ID NO:809. The peptide-bound support is removed from the synthesizer column and placed in a react-vial containing a small magnetic bar for gentle stirring.

Removal of the Allyl Groups

A solution of tetrakis(triphenylphosphine)Palladium(0) Pd(PPh$_3$)$_4$ (from Sigma-Aldrich, catalog No: 21,666-6); M.W.=1155.58×0.1 mmol peptide×3 fold=347 mg dissolved in 5% Acetic Acid; 2.5% NMM in CHCl$_3$ to 0.14 M, under argon. The solution is added to the support-bound peptide previously removed from the column in a reactvial containing a small magnetic bar for gentle stirring. The mixture is flushed with argon, sealed and stirred at room temperature for 6 hours. The support-bound peptide is transferred to a filter funnel, washed with 30 ml of a solution made of 0.5% Sodium Diethyldithiocarbonate/in DMF, then DCM; then DCM/DMF (1:1), and finally DMF. A positive Kaiser test indicated the deprotection of the amino side chain of the Lys20.

Lactam Formation:

Activating agent: 7-Azabenztriazol-1-yloxytris(pyrrolindino) phosphonium-hexafluorophosphate (PyAOP: M.W.=521.7 from PerSeptive Biosystems GmbH, catalog No: GEN076531), 1.4-fold: 0.105 mmol×1.4×521.7=76.6 mg and NMM 1.5-fold: 0.105×1.4×1.5=0.23 mmol v=0.23/0.9 M NMM solution=263 µl).

The cyclization may be carried out in an amino acid vial at room temperature overnight (~16 hours) with gentle agitation. The completion of cyclization may be indicated by a negative kaiser test. The support-bound peptide may be poured into the column, washed with DMF and the synthesis continues to completion, with a cyclic amide bridge thereby introduced into the peptide.

Final Product Removal from the Support:

The support-bound peptide is removed from the synthesizer in to a medium filter funnel, washed with DCM to replace the non-volatile DMF and thoroughly dried under high vacuum for at least two hours, or preferably, overnight.

Cleavage Mixture (Reagent K):
TFA/Phenol/Water/Thio-Anisol/EDT (82/5/5/5/2.5); 7.5 ml Support: 0.5 g resin-peptide.

| | |
|---|---|
| TFA | 6.15 ml (Biograde from Halocarbon) |
| Phenol | 0.375 ml (Aldrich) |
| Water | 0.375 ml (MilliQ) |
| Thio-Anisol | 0.375 ml (Aldrich) |
| EDT | 0.187 ml (Aldrich) |
| Total | 7.5 ml |

The cleavage may be performed at room temperature for 4 hours with gentle agitation on a rocker.

Precipitation of the Peptide

The cleaved peptide solution is filtered through a filter funnel in a 50 ml round bottom flask. The support is rinsed twice with 4 ml TFA. The TFA solution is concentrated on a rotavap and added drop wise into a cold diethyl ether previously treated with activated neutral aluminum oxide to make it free of peroxide. Approximately 10-fold excess of ether are used. The beads are stored until the yield is determined and the peptide characterized. The precipitate is collected at room temperature in screw capped 50 ml polypropylene vial by centrifugation at 2K rpm, using a top bench centrifuge (4 minutes run time). The pellet is washed 3× with cold ether, centrifuged and dried with a flow of argon. The precipitate is dissolved in 20% acetonitrile 0.1% TFA and lyophilized.

Crude Product Characterization:

The product is characterized by analytical HPLC.

Experimental conditions: Column: Vydac 218TP54: C18 reversed-phase 5 µm, 4.6 mm ID×150 mm L.

Eluants: 0.1% TFA/H2O (solvent A); 0.1% TFA/acetonitrile (solvent B).

Elution Conditions: 20-50% B (40 min); 60-90% B (5 min); 90-20% B (5 min); 20% B (10 min). At 1.0 ml/min and A214 nm=0.5 absorbance unit full scale.

Sample Preparation:

An aliquot of the product is weighed and dissolved in 20% acetonitrile 0.1% TFA at a concentration of 2 mg/ml. The solution is microfuged and 20 µl is applied onto the column. The main peak or the major peaks are collected, SpeedVac dried and molecular weight determined by mass spectrometry.

The structures of the compounds used in this study are shown below (underlined residues are cyclized).

Compound A or f400 (SEQ ID NO:405), wherein R=H, Xaa$_1$=Cys, Xaa$_2$=Cys, [linker]=4×Gly):
H$_2$N-Lys-Pro-Val-Ser-Leu-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH$_2$ (SEQ ID NO:809).

Compound B or f400 (SEQ ID NO:405), wherein R=H, Xaa$_1$=Ala, Xaa$_2$=Phe, [linker]=4×Gly):
H$_2$N-Lys-Pro-Val-Ser-Leu-Ser-Tyr-Arg-Ala-Pro-Phe-Arg-Phe-Phe-[Gly-Gly-Gly-Gly]-Leu-Lys-Trp-Ile-Gln-Glu-Tyr-Leu-Glu-Lys-Ala-Leu-Asn-NH$_2$ (SEQ ID NO:810).

Compound C or f400 (SEQ ID NO:405), wherein R=Ac, Xaa$_1$=Cys, Xaa$_2$=Cys, [linker]=4×Gly):
AcHN-Lys-Pro-Val-Ser-Leu-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH$_2$ (SEQ ID NO:811).

Compound D or f400 (SEQ ID NO:405), wherein R=Ac, Xaa$_1$=Cys, Xaa$_2$=Cys, [linker]=11 aminoundecanoic acid):
AcHN-Lys-Pro-Val-Ser-Leu-Ser-Tyr-Arg-Cys-Pro-Cys-Arg-Phe-Phe-[11 aminoundecanoic acid]-Leu-Lys-Trp-Ile-Gln-Glu-Tyr-Leu-Glu-Lys-Ala-Leu-Asn-NH$_2$ (SEQ ID NO:812).

Compound E or f401 (SEQ ID NO:406), wherein Xaa$_3$=desLys, Xaa—Cys, Xaa$_2$=Cys, [linker]=4×Gly):
H$_2$N-[desNH$_2$ Lys]-Pro-Val-Ser-Leu-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH$_2$ (SEQ ID NO:813).

Compound F or f402 (SEQ ID NO:407), wherein Xaa$_3$=D-Pro, Xaa$_1$=Cys, Xaa$_2$=Cys, [linker]=4×Gly):
H$_2$N-Lys-[D-Pro]-Val-Ser-Leu-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH$_2$ (SEQ ID NO:814).

Compound G or f405 (SEQ ID NO:410), wherein Xaa$_3$=D-Pro, Xaa$_1$=Cys, Xaa$_2$=Cys, [linker]=4×Gly):
H$_2$N-Lys-Pro-Val-Ser-[D-Pro]-Ser-Tyr-Arg-Cys-Pro-Cys-Arg-Phe-Phe-[Gly-Gly-Gly-Gly]-Leu-Lys-Trp-Ile-Gln-Glu-Tyr-Leu-Glu-Lys-Ala-Leu-Asn-NH$_2$ (SEQ ID NO:815).

Compound H or f400 (SEQ ID NO:405), wherein R=H, Xaa$_1$=Cys, Xaa$_2$=Cys, [linker]=11aminoundecanoic acid:
H$_2$N-Lys-Pro-Val-Ser-Leu-Ser-Tyr-Arg-Cys-Pro-Cys-Arg-Phe-Phe-[11 aminoundecanoic acid]-Leu-Lys-Trp-Ile-Gln-Glu-Tyr-Leu-Glu-Lys-Ala-Leu-Asn-NH$_2$ (SEQ ID NO:816).

Example 4

This example illustrates the efficacy of SDF-1 peptide analogs (as represented by Compound A (SEQ ID NO:809) and Compound B (SEQ ID NO:810)) in mobilizing circulating neutrophils in a mouse model. Increases in the number of circulating neutrophils due to SDF-1 peptide analog administration is shown in Table 2. This study consisted of three groups of female Balb/c mice (Charles River, Wilmington, Mass.): an untreated control group of 6 mice and two 18-mouse test groups. Before the start of the study, 20-23 g mice were randomly grouped in appropriately labeled cages and identified by cage markings and shaved marks on the dorsal region. The two test groups were treated one time intravenously with SDF-1 analogs at a dose of 2.5 mg/kg in volumes approximating 200 µl. The evaluated end points included moribundity and complete blood counts with differentials. Blood samples were obtained from 6 mice from each test group at t=30 minutes, 1 hour and 24 hours post analog administration. Prior to blood collection, mice were weighed and anesthetized. Blood was collected via a 1 cc syringe and 25 G needle (Becton Dickinson/VWR) by cardiac puncture. One fresh blood smear was produced. The remaining blood was expelled into a Becton Dickinson EDTA microtainer and mixed gently by 5 inversions. The smear and microtainer tubes were used for differential and CBC analysis on a Cell-Dyn 3500 (Abbott Diagnostic Products, Mississauga, Ontario, Canada) and by veterinarians (Central Laboratory for Veterinarians, Langley, B.C, Canada). The differentials were used to evaluate the mobilization of neutrophils and were compared to the untreated control group. The results are expressed as percentage of the count from untreated control animals and are representative of at least two experiments each with six animals per treatment. A time-dependent mobilization of neutrophils to the circulation is shown, indicating the rapid and potent activity of the peptide analogs. Compound B (represented by SEQ ID NO:810) exhibits an especially rapid and sustained action.

TABLE 2

Percentage change in circulating neutrophils in Balb/c mice treated with 2.5 mg/kg of the designated compound compared to untreated control animals.

| Compound | Duration of treatment (hours) | | |
|---|---|---|---|
| | ½ | 1 | 24 |
| Compound A | 175% | 299% | 25% |
| Compound B | 348% | 304% | 113% |

Example 5

This example illustrates the stability of SDF-1 chemokine analogs (as represented by Compound A (SEQ ID NO:809) and Compound B (SEQ ID NO:810)) in human plasma.

Methods

In Vitro Incubations of Chemokine Analogs with Plasma

Fresh blood was collected into heparinized tubes and spun down at room temperature for 15 minutes at 1500 g, and the plasma was removed and placed in another tube. The plasma was then cooled to 4° C. by incubation on ice, and centrifuged for 15 minutes at 1500 g at 4° C. The plasma was recovered and used immediately and the leftover was frozen at −20° C.

Fractions of 0.5 ml of human plasma were aliquoted in eppendorf tubes and incubated in a heated bath at 37° C. A quantity of 200 µg of Compound B (SEQ ID NO:810) or Compound A (SEQ ID NO:809) in water (10 µg/µL in water) was added subsequently to each fraction and incubated for T=0, 5, 10, 20, 30, 60, 120, 240, 360 and 420 minutes. At the end of the incubation, the fractions were quenched by the addition of 0.20 ml 1M trifluoroacetic acid (TFA) and the tubes agitated gently and kept on ice for 10 minutes. The tubes were then diluted further with 200 µL of a 0.05% solution of TFA.

The samples were then centrifuged at 5000 rpm for 45 min at 4° C. The supernatants were extracted on solid phase.

Solid Phase Extraction of Human Plasma Samples

Sep-pak C18 cartridges (VWR #BJ9000, 100 mg, 1 ml, octadecyl column C18)) were preconditioned with 80% acetonitrile/0.1% TFA (5×1 ml) followed by TFA 0.05% (5×1 ml). The quenched (acidified) plasma samples were aspirated and applied to the column, and washed with 2×1 ml of TFA 0.05% (eluate discarded) followed by extraction with 5×1 ml of (80% acetonitrile/0.1% TFA). The samples were then frozen and lyophilized.

Dry residue was resuspended in 200 µL of (20% acetonitrile/0.1% TFA) and spun down in a centrifuge to clarify the sample by centrifugation at 5000 rpm for 15 minutes at 22° C. before loading 50 µL on HPLC.

High Performance Liquid Chromatography

HPLC analysis was performed on the Gilson using the following column, mobile phase, and detection systems.

| Column: | Vydac C18 (5 µm, 250 mm × 4.6 mm) | |
|---|---|---|
| Injection volume: | 50 µL | |
| Mobile phase: | A: | 0.1% TFA in water |
| | B: | 0.1% TFA in acetonitrile |
| | Gradient: | was 30-90% B in 45 min; |
| Flow rate | 1 ml/min | |
| Detection | 214 nm | |

TABLE 3

Stability study of designated compound in human plasma. Percentage of compound remaining in plasma after incubation. ND: not determined.

| Compound | Duration of incubation with plasma (minutes) | | | | | | | | | |
|---|---|---|---|---|---|---|---|---|---|---|
| | 0 | 5 | 10 | 20 | 30 | 60 | 120 | 240 | 360 | 420 |
| Compound A | 100% | 32% | 26% | 21% | 8% | 9% | ND | ND | ND | ND |
| Compound B | 100% | 67% | 56% | 67% | 56% | 77% | 52% | 43% | 26% | 17% |

Example 6

Tables 4 and 5 show the effect of CXCR4 agonists on bone marrow progenitor cells, particularly primitive erythroid cells and primitive granulocytes, compared to mature granulocytes. To obtain the data in Tables 4 and 5, cells were pre-incubated with each of the compounds or saline alone ('no drug' as control). The cells were then exposed to high dose $^3$H-thymidine, a cytotoxic agent. Rapidly dividing cells accumulate proportionally more of the cytotoxic radioactive thymidine and as a result are preferentially killed. The relative proportion of cells killed by the thymidine treatment compared to the control is indicative of the relative effectiveness of the compounds in reducing cellular multiplication, i.e., decreasing the rate of cell cycle progression. A higher (or unchanged) proportion of killed cells compared to the control is indicative that a compound does not reduce cellular multiplication of the given cell type.

TABLE 4

Effect of CXCR4 Agonists on Bone Marrow Progenitor Cells Exposed to $^3$H-Thymidine.

| | % CELL KILLED | | |
|---|---|---|---|
| | No drug (control) | SDF-1 | SDF-1(1-9)2 |
| Primitive Erythroid | 71 | 2 | 9 |
| Primitive Granulocyte | 46 | 1 | 1 |
| Mature Granulocyte | 39 | 45 | 42 |

In Table 4, SDF-1 polypeptide (Lys-Pro-Val-Ser-Leu-Ser-Tyr-Arg-Cys-Pro-Cys-Arg-Phe-Phe-Glu-Ser-His-Val-Ala-Arg-Ala-Asn-Val-Lys-His-Leu-Lys-Ile-Leu-Asn-Thr-Pro-Asn-Cys-Ala-Leu-Gln-Ile-Val-Ala-Arg-Leu-Lys-Asn-Asn-Asn-Arg-Gln-Val-Cys-Ile-Asp-Pro-Lys-Leu-Lys-Trp-Ile-Gln-Glu-Tyr-Leu-Glu-Lys-Ala-Leu-Asn)(KPVSL SYRCP CRFFE SHVAR ANVKH LKILN TPNCA LQIVA RLKNN NRQVC IDPKL KWIQE YLEKA LN (SEQ ID NO:1)) was used at 100 ng/ml on a human bone marrow cell culture. SDF-1(1-9)$_2$ Lys-Pro-Val-Ser-Leu-Ser-Tyr-Arg-Cys-linker-(carboxy terminus)Cys-Arg-Tyr-Ser-Leu-Ser-Val-Pro-Lys (amino terminus) (SEQ ID NO:802)) was used at 50 μg/ml on a human bone marrow cell culture.

Table 5 further demonstrates that SDF-1(1-14)-(Gly)$_4$-SDF-1(55-67)-amide (SEQ ID NO:801) and SDF-1(1-14)-(Gly)$_4$-SDF-1 (55-67)-Lys20/Glu24-cyclic amide (SEQ ID NO:809) were both able to inhibit cell cycling in human positive erythroid and primitive granulopoietic cells, but not in mature granulopoietic cells, in the assay as described above in this Example.

TABLE 5

| | % CELL KILLED | | |
|---|---|---|---|
| | No drug (control) | Compound A | Compound B |
| Primitive Erythroid | 47 +/− 4 | 5 +/− 3 | −7 +/− 6 |
| Primitive Granulocyte | 42 +/− 3 | 1 +/− 6 | −11 +/− 7 |
| Mature Granulocyte | 48 +/− 3 | 39 +/− 5 | 44 +/− 6 |

Where:

Compound I is SDF-1(1-14)-(Gly)$_4$-SDF-1(55-67)-amide (SEQ ID NO:801);
Compound A is SDF-1(1-14)-(Gly)$_4$-SDF-1(55-67)-Lys20/Glu24-cyclic amide (SEQ ID NO:809)

Example 7

The present example demonstrates the therapeutic effectiveness of CXCR4 agonists in an animal model, showing protection of hematopoietic cells from cytotoxic treatments with CXCR4 agonists. In these animal studies, normal mice were treated with the cytotoxic chemotherapeutic agent arabinose-cytosine (Ara-C), which are known to deleteriously affect cells with high rates of DNA synthesis (reflecting rapid cell cycling).

Figure 3:
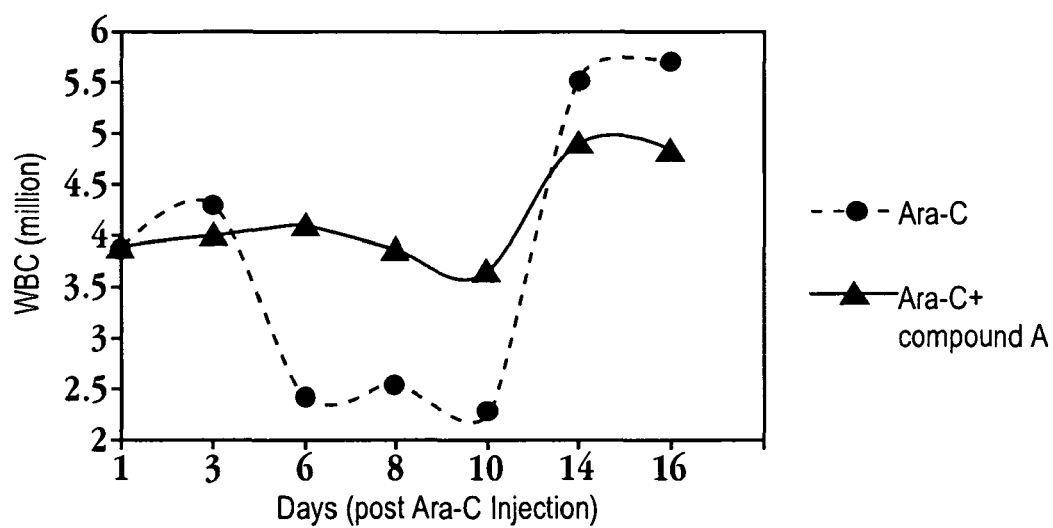
FIG. 3 shows the effect of Ara-C (350 mg/kg) on White Blood Cell Count (WBC) in mice in the presence (triangular data points, solid line, designated Ara-C+Compound A in the legend) and absence (circular data points, dashed line, designated Ara-C in the legend) of a peptide of the invention.

As shown in the graph of FIG. 3, in mice given a single dose of Arabinose Cytosine (Ara-C) at 350 mg/kg at day zero intravenously, white blood cell count (WBC) decreases (due to the cytotoxic action of Ara-C). In contrast, in mice given the peptide SDF-1(1-14)-(Gly)$_4$-SDF-1(55-67)-Lys20/Glu24-cyclic amide (SEQ ID NO:809) (designated CTC in the graph legend) in combination with Ara-C, the extent of white blood cell count decrease is significantly ameliorated. In the graph, circular data points correspond to the white blood cell count in animals that received Ara-C but did not receive the peptide, and triangular data points are for animals that received Ara-C and SDF-1(1-14)-(G)$_4$-SDF-1(55-67)-Lys20/Glu24-cyclic amide (SEQ ID NO:809). The data clearly demonstrated the protective action of the peptide of the invention against the cytotoxic action of Ara-C.

Example 8

Figure 4A:
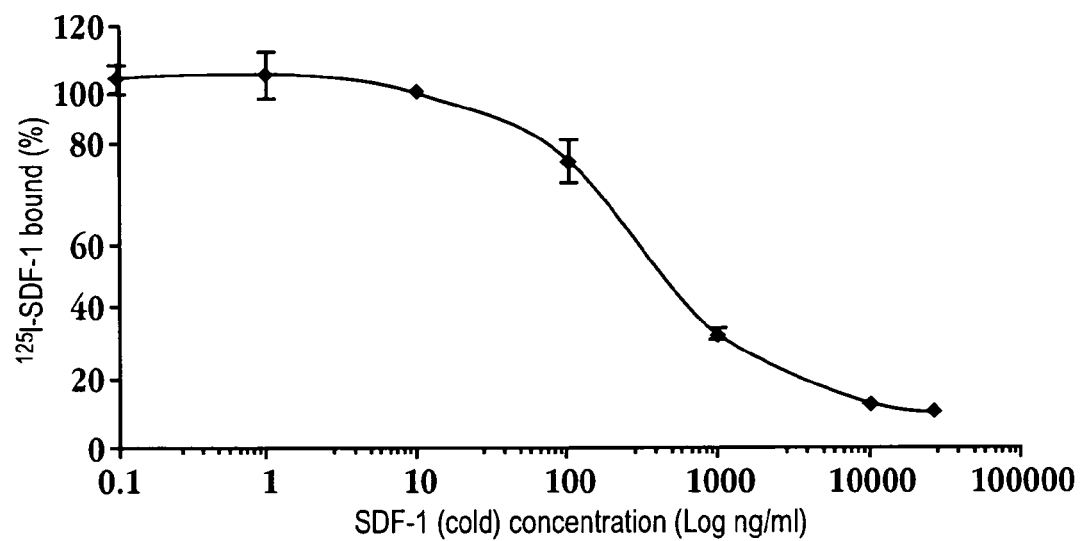
FIG. 4A shows a concentration-dependant inhibition of $^{125}$I-SDF-1 binding to CXCR4 by SDF-1, obtained as described for the data shown in FIGS. 4A-4B, indicating the affinity of SDF-1 for the CXCR4 receptor.
Figure 4B:
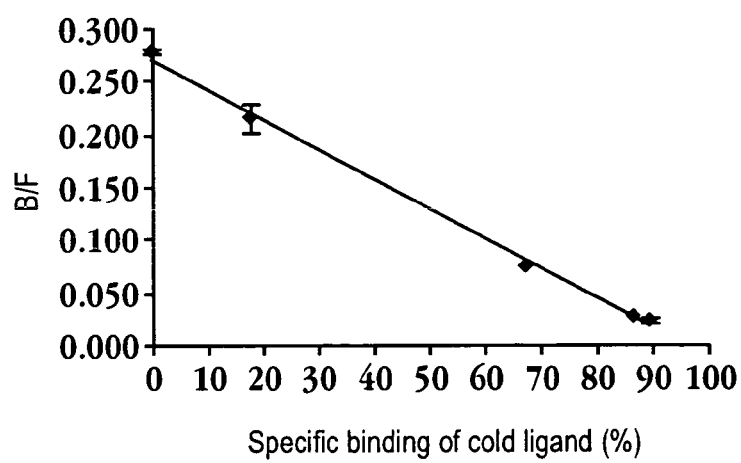
FIG. 4C shows the CXCR4 receptor binding of SDF-1 and the SDF-1 peptide agonist analogs. SDF-1 and the indicated analogs (competing ligands, described in Examples) were added at the concentrations illustrated in the presence of 4 nM $^{125}$I-SDF-1. CEM cells were assessed for $^{125}$I-SDF-1 binding following 2 hr of incubation. The results are expressed as percentages of the maximal specific binding that was determined without competing ligand, and are the mean of three independent experiments.
Figure 4C:
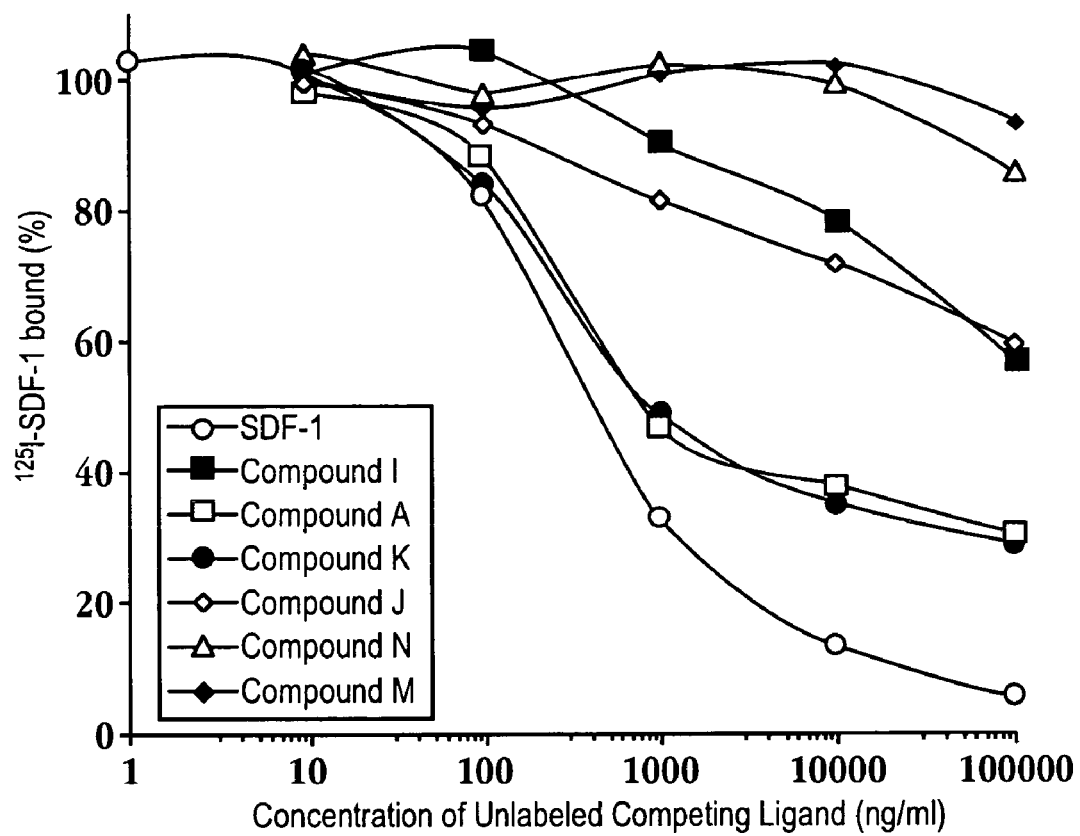

The efficacy of SDF-1 and SDF-1 peptide analogs as CXCR4 agonists was demonstrated through CXCR4 receptor binding assays. A competitive dose response for binding to the SDF-1 receptor by native SDF-1 (SEQ ID NO:1) and the CXCR4 agonists against $^{125}$I-SDF-1 is shown in FIGS. 4A through 4C respectively. A concentration-dependent inhibition of $^{125}$I-SDF-1 is illustrated in FIG. 4A, indicating the affinity of SDF-1 for the receptor. A Scatchard plot is illustrated in FIG. 4B, and the KD was determined to be 26 nM. SDF-1 and the indicated analogs (competing ligands) were added at the concentrations illustrated in FIG. 4C in the presence of 4 nM $^{125}$I-SDF-1. CEM cells were assessed for $^{125}$I-SDF-1 binding following 2 hr of incubation. The results are expressed as percentages of the maximal specific binding that was determined without competing ligand, and are the mean of three independent experiments. The inhibition of $^{125}$I-SDF-1 by SDF-1 and the SDF-1 analogs is indicative of CXCR4 receptor binding. The compounds illustrated in the figure are as follows: Compound A/SDF-1(1-14)-(Gly)$_4$-SDF-1(55-67)-Lys20/Glu24-cyclic amide (SEQ ID NO:809), Compound K/SDF-1(1-14)-(Gly)$_4$-SDF-1(55-67)-Glu24/Lys28-cyclic amide (SEQ ID NO:803), Compound J/SDF-1 (1-9)$_2$-Cys9/Cys9-cysteine dimer (SEQ ID NO:802), Compound N/SDF-1(1-17) (SEQ ID NO:804), Compound M/SDF-1 (1-8)$_2$-lysine bridge dimer (SEQ ID NO:805) and Compound I/SDF-1(1-14)-(G)$_4$-SDF-1(55-67) amide (SEQ ID NO:801).

Example 9

Figure 5:
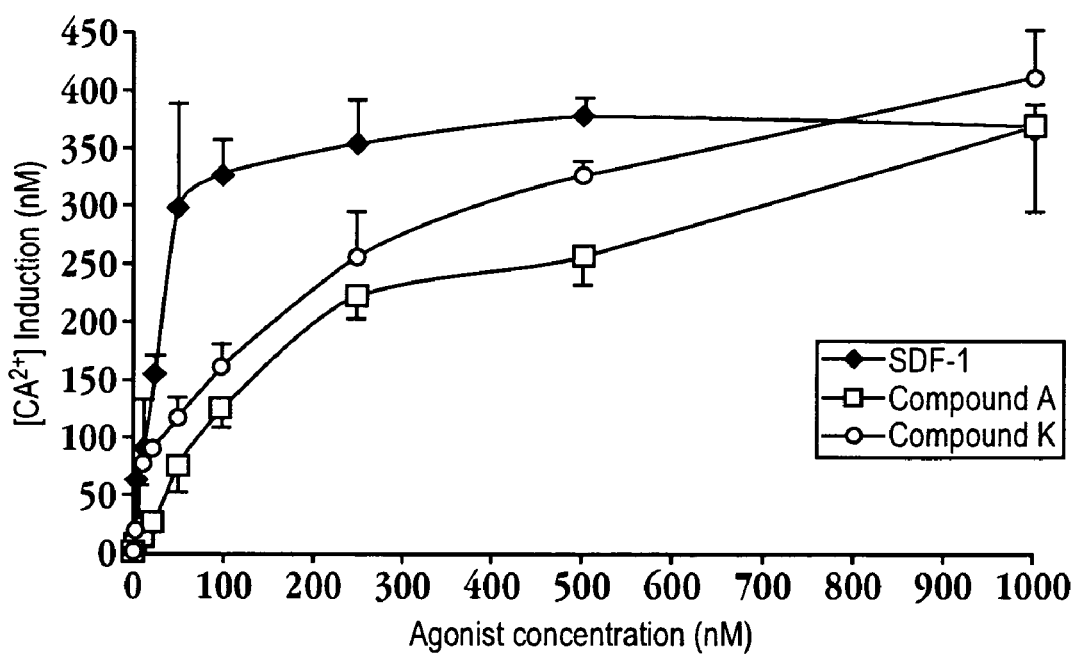
FIG. 5 shows the induction of $[Ca^{2+}]_i$ mobilization by SDF-1 and SDF-1 receptor analogs (described in Examples). Fura-2,AM loaded THP-1 cells ($1 \times 10^6$/ml) were stimulated with SDF-1, Compound A or Compound K at the concentrations indicated. The values represent the mean+/−one S.D. of n=3 experiments.

This example illustrates the efficacy of SDF-1 and SDF-1 peptide analogs in mediating intracellular calcium mobilization ([Ca$^2$+]$_i$). To illustrate that the binding of SDF-1 and SDF-1 peptide analogs results in the agonistic induction of the CXCR4 receptor, [Ca$^2$+]$_i$ mobilization assays were conducted, the results of which are shown in FIG. 5. To obtain the data shown in FIG. 5, fura-2,AM loaded THP-1 cells (1×10$^6$/ml) were stimulated with Compound A/SDF-1, SDF-1(1-14)-(G)$_4$-SDF-1(55-67) Lys20/Glu24-cyclic amide (SEQ ID NO:809) or Compound K/SDF-1(1-14)-(G)$_4$-SDF-1(55-67)-Glu24/Lys28-cyclic amide (SEQ ID NO:803) at the concentrations indicated (the values represent the mean+/−one S.D. of n=3 experiments). As shown by the data in FIG. 5, incubation of THP-1 cells with SDF-1, SDF-1(1-14)-(G)$_4$-SDF-1(55-67) Lys20/Glu24-cyclic amide (SEQ ID NO:809) or SDF-1(1-14)-(G)$_4$-SDF-1(55-67)-Glu24/Lys28-cyclic amide (SEQ ID NO:803) resulted in the receptor-mediated induction of [Ca$^2$+]$_i$ mobilization. The EC$_{50}$ values (the concentration of ligand necessary to effectively induce 50% of the full [Ca$^2$+]$_i$ mobilization potential) for SDF-1(1-14)-(G)$_4$-SDF-1(55-67) acid (SEQ ID NO:806), SDF-1(1-14)-(G)$_4$-SDF-1(55-67)-Lys20/Glu24-cyclic amide (SEQ ID NO:809) or SDF-1(1-14)-(G)$_4$-SDF-1(55-67)-Glu24/Lys28-cyclic amide (SEQ ID NO:803) and native SDF-1 is shown in Table 6:

TABLE 6

| Compound | EC$_{50}$ (nM) |
| --- | --- |
| SDF-1 | 26.56 |
| SDF-1(1-14)-(Gly)$_4$-SDF-1(55-67)-Glu24/Lys28-cyclic amide (SEQ ID | 106.25 |
| SDF-1(1-14)-(Gly)$_4$-SDF-1(55-67)-Lys20/Glu24-cyclic amide (SEQ ID | 147.94 |
| SDF-1(1-14)-(Gly)$_4$-SDF-1(55-67) acid (SEQ ID NO:806) | 188.30 |

Figure 6:
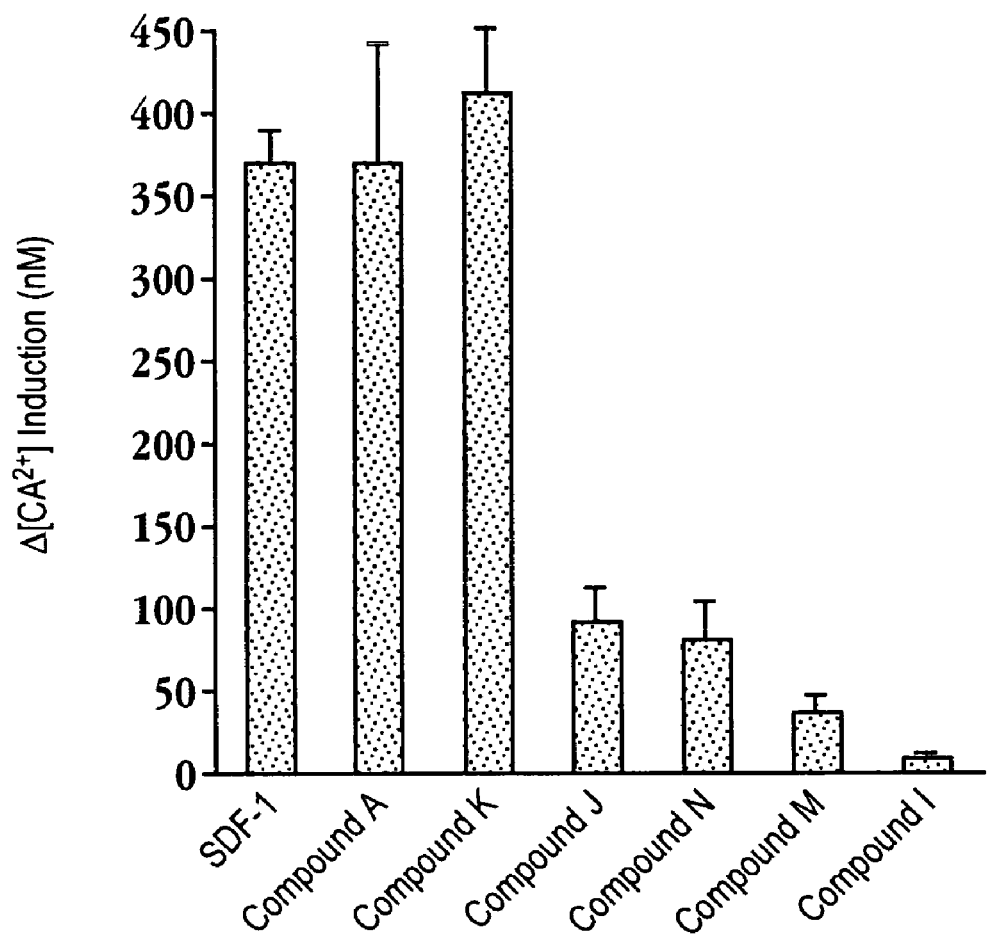
FIG. 6 shows the induction of $[Ca^{2+}]_i$ mobilization by SDF-1 and SDF-1 analogs. Fura-2,AM loaded THP-1 cells ($1 \times 10^6$/ml) were stimulated with native SDF-1 and the SDF-1 peptide analogs at the concentration of native SDF-1 concentration that gave the maximum $[Ca^{2+}]_i$ stimulation (1 μM). The values represent the mean+/−one S.D. of n=3 experiments. The designated compounds are as follows: SDF-1; Compound A (SDF-1(1-14)-(Gly)$_4$-SDF-1(55-67)-Lys20/Glu24-cyclic amide (SEQ ID NO:809)); Compound K (SDF-1(1-14)-(Gly)$_4$-SDF-1(55-67)-Glu24/Lys28-cyclic amide (SEQ ID NO:803)); Compound J (SDF-1 (1-9)$_2$-Cys9/Cys9-cysteine dimer (SEQ ID NO:802)); Compound N (SDF-1(1-17) (SEQ ID NO:804)); Compound M/SDF-1 (1-8)$_2$-lysine bridge dimer (SEQ ID NO:805)); and Compound I/SDF-1(1-14)-(G)$_4$-SDF-1(55-67) amide (SEQ ID NO:801).

The comparative ability of SDF-1, Compound A/SDF-1(1-14)-(G)$_4$-SDF-1(55-67)-Lys20/Glu24-cyclic amide (SEQ ID NO:809), Compound K/SDF-1(1-14)-(G)$_4$-SDF-1(55-67)-Glu24/Lys28-cyclic amide (SEQ ID NO:803), Compound J/SDF-1 (1-9)$_2$-Cys9/Cys9-cysteine dimer (SEQ ID NO:802), Compound N/SDF-1(1-17) (SEQ ID NO:804), Compound M/SDF-1 (1-8)$_2$-lysine bridge dimer (SEQ ID NO:805) and Compound I/SDF-1(1-14)-(G)$_4$-SDF-1(55-67) amide (SEQ ID NO:801) to induce [Ca$^2$+]$_i$ mobilization at the ligand concentration that the native SDF-1 gave maximal [Ca$^2$+]$_i$ mobilization (1 µM, refer to FIG. 5) is illustrated in FIG. 6. Fura-2,AM loaded THP-1 cells (1×10$^6$/ml) were stimulated with native SDF-1 and the SDF-1 peptide agonist analogs at the concentration of native SDF-1 that gave the maximum [Ca$^2$+]$_i$ stimulation (1 µM) (the values represent the mean+/−one S.D. of n=3 experiments).

Example 10

Primitive high proliferative potential colony forming cells (HHP-CFC) in an adherent layer in culture are usually in a quiescent state. This long term culture (LTC) is established seven to ten days after initiation of the LTC. The cells may be stimulated to proliferate by the addition of fresh medium. Both BFU-E (burst forming unit—erythroid precursor) cells and CFU-GM (colony forming unit—granulocyte-monocyte common precursor) cells of LTC may be maintained in a quiescent state by the mesenchymally derived stromal cells in an adherent layer, but can be reversibly stimulated into the cycle by the addition of fresh media. The ability of CXCR4 agonists such as SDF-1 and SDF-1 polypeptides to overcome this activation may be determined by adding it to the LTC during the medium change. Rapidly dividing cells will accumulate proportionally more of a cytotoxic agent, such as radioactive thymidine, and as a result are preferentially killed.

The results depicted in Table 7 illustrate the ability of SDF-1, and SDF-1(1-14)-(G)$_4$-SDF-1(55-67)-Lys20/Glu24-cyclic amide (SEQ ID NO:809) and SDF-1(1-14)-(G)$_4$-SDF-1(55-67) acid (SEQ ID NO:806) to repress the proliferation of clonogenic erythroid and granulopoitic progenitors (which differentiate into erythrocytes, platelets, monocytes/macrophages and neutrophils) in an in vitro LTC-IC (long-term culture-initiating cells) assay.

TABLE 7

Effect of SDF-1 and SDF-1 agonists on the cycling of primitive progenitors in the adherent layer of human LTC.

| | | % CELL KILLED after $^3$H-Thymidine | |
| --- | --- | --- | --- |
| Treatment | Dose | Primitive BFU-E | Primitive CFU-GM |
| None | | 48 +/− 4 | 44 +/− 3 |
| SEQ ID NO:806 | 1 µg/ml | 24 +/− 6 | 22 +/− 7 |
| | 10 µg/ml | 0 +/− 2 | 0 +/− 0 |
| SDF-1 | 1 µg/ml | 4 +/− 3 | 5 +/− 4 |
| SEQ ID NO:809 | 1 µg/ml | 2 +/− 4 | 0 +/− 3 |

To obtain the results set out in Table 7, clonogenic erythroid (BFU-E) and granulopoietic (CFU-GM) progenitors were assayed in methylcellulose cultures. Adherent cells were treated with fresh medium alone (as control) or with the indicated CXCR4 agonist (10 µg/ml SDF-1, SEQ ID NO:809 or SEQ ID NO:806). Dishes were harvested three days later and $^3$H-thymidine suicide assays performed on the progenitor cells in the adherent layer to determine the proportion of cells killed as a result of accumulation of cytotoxic $^3$H-thymidine, where the difference between the cells in the control and the number of cells remaining represent the cells killed.

Figure 7:
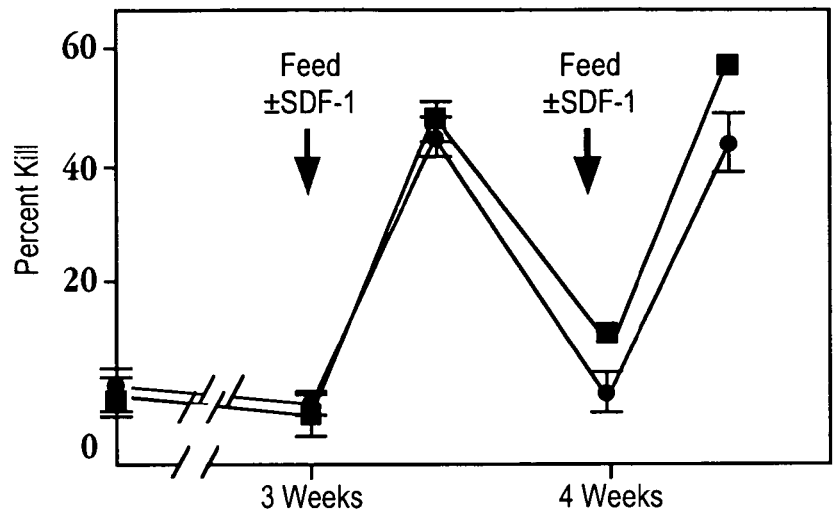
FIG. 7 shows cyclic proliferative activity of primitive normal colony forming cells (CFC) in the adherent layer of a standard long term culture (LTC), in which circles represent BFU-E cells (burst forming unit-erythroid precursors), and squares represent CFU-GM cells (colony forming unit—granulocyte-monocyte common precursor), illustrating the inhibitory effect of SDF-1 on cellular proliferation as measured by the susceptibility of the cells to an agent preferentially cytotoxic to proliferating cells.
Figure 8:
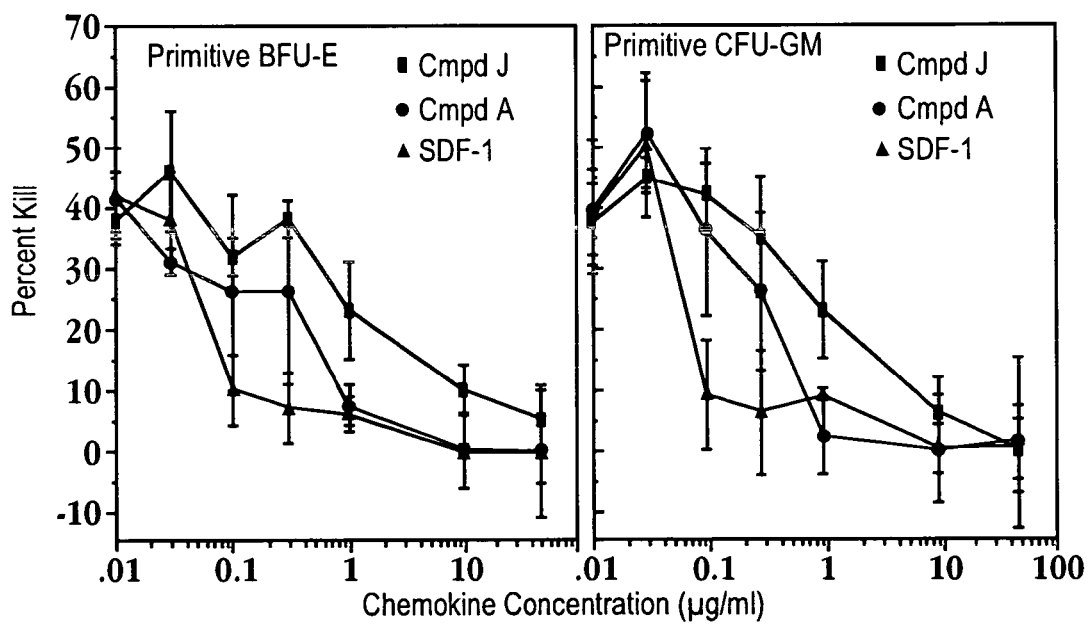
FIG. 8 shows cyclic proliferative activity of primitive normal CFC in the adherent layer of standard LTC, when treated with SDF-1, SDF-1(1-14)-(Gly)$_4$-SDF-1(55-67)-Lys20/Glu24-cyclic amide (Compound A (SEQ ID NO:809)), SDF-1(1-9)$_2$ (Compound J (SEQ ID NO:802)), as measured by the susceptibility of the cells to an agent preferentially cytotoxic to dividing cells.

FIG. 7 illustrates that feeding cultures with SDF-1 in conjunction with media changes results in significantly reduced cell mortality of hematopoietic cells when the cells are challenged with an agent that is preferentially cytotoxic to dividing cells, in which circles represent BFU-E cells (burst forming unit-erythroid precursors), and squares represent CFU-GM cells (colony forming unit-granulocyte-monocyte common precursor). FIG. 8 shows that a similar concentration dependent effect may be obtained with SDF-1(1-14)-(G)$_4$-SDF-1(55-67)-Lys20/D24-cyclic amide (Compound A) (SEQ ID NO:809) and SDF-1(1-9)$_2$ (Compound J) (SEQ ID NO:802). Together, FIGS. 7 and 8 illustrate that the SDF-1 polypeptide and SDF-1 peptide analogs repress the cyclic activation of the BFU-E and CFU-GM progenitor stem cells in the adherent layer of LTC.

Example 11

Figure 9:
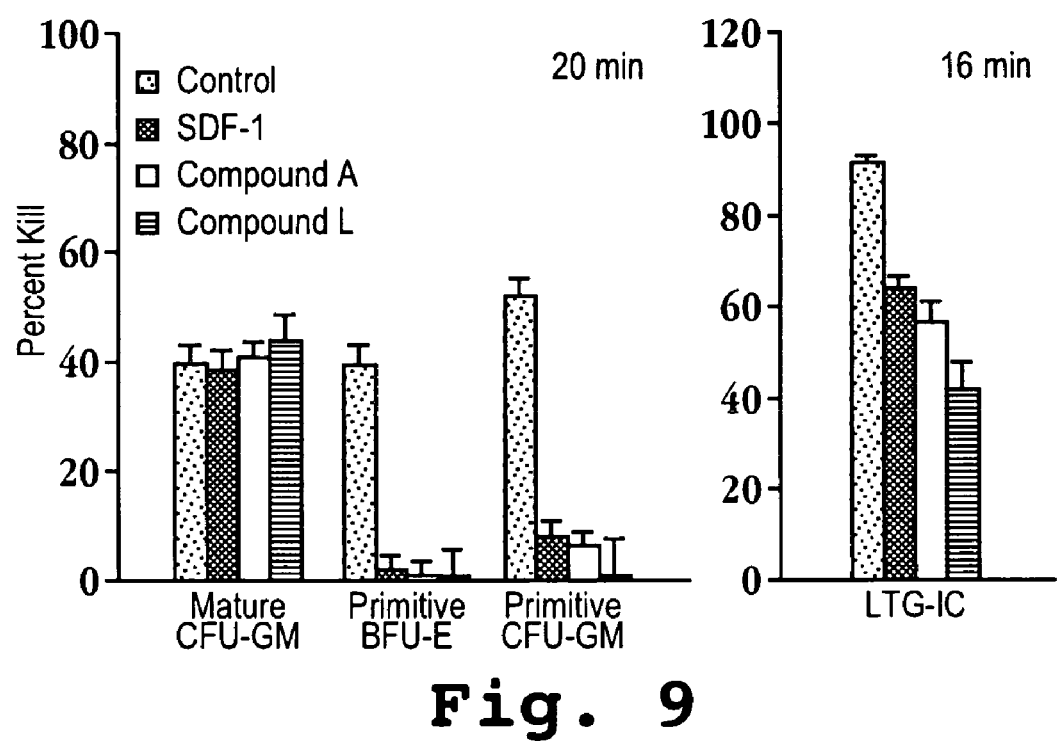
FIG. 9 shows the effect of SDF-1 and SDF-1 analogs (defined in Examples) on the cycling of human progenitors from fetal liver transplanted NOD/SCID mice. The cycling status of mature and primitive colony forming cells (CFU-GM; colony forming unit-granulocyte-monocyte precursor, BFU-E; burst forming unit-erythroid precursor) in the suspension of CD34+ cells isolated from the marrow of transplanted NOD/SCID mice was determined by assessing the proportion of these progenitors that were inactivated (killed) by short term (20 min) or overnight (LTC-IC; long-term culture initiating cell) exposure of the cells to 20 μg/ml of high specific activity $^3$H-thymidine. Values represent the mean+/− the S.D. of data from up to four experiments with up to four mice per point in each.
Figure 11:
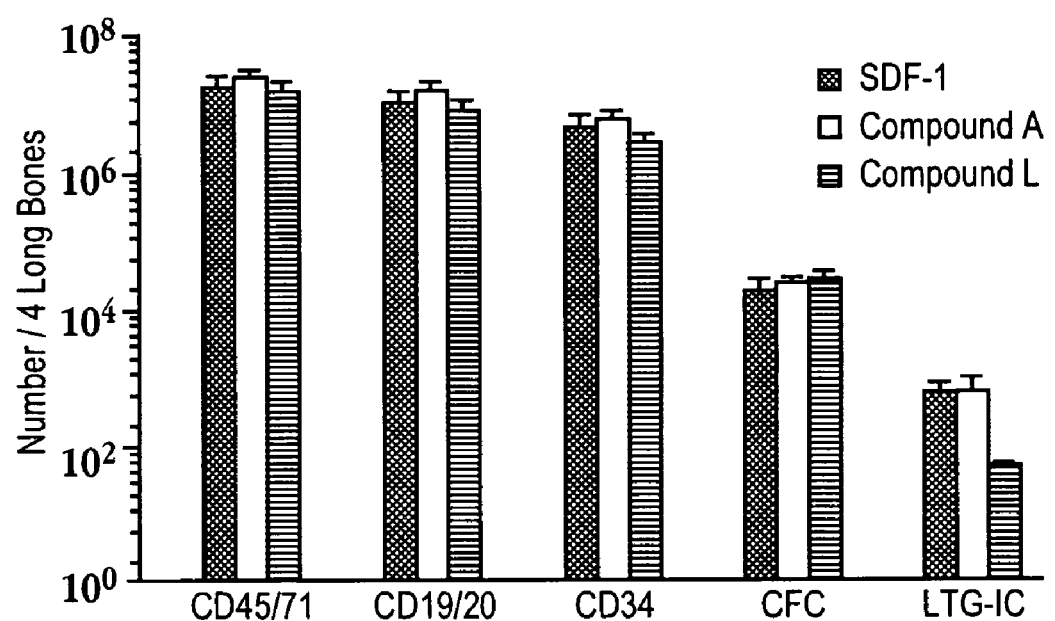
FIG. 11 shows the effect of SDF-1 and SDF-1 Agonists (defined in Examples) on the engraftment of human cells in human fetal liver transplanted NOD/SCID mice. A comparison of the number of phenotypically defined hematopoietic cells detected in the long bones (tibias and femurs) of mice four weeks after being transplanted with 107 light-density human fetal liver blood cells and then administered SDF-1, Compound A (SEQ ID NO:809) or Compound L (SEQ ID NO:806) (0.5 mg/kg) three times per week for two weeks before sacrifice. Values represent the mean+/−one S.D. of results obtained from three to seven individual mice in three experiments.

FIGS. 9 and 11 show the efficacy of CXCR4 agonists such as SDF-1 and SDF-1 analogues in repressing the proliferation of human progenitor cells in an in vivo engraftment model.

In FIG. 9, the cycling status of mature and primitive colony forming cells (CFU-GM; colony forming unit-granulocyte-monocyte precursor, BFU-E; burst forming unit-erythroid precursor; LTC-IC, long-term culture initiating cell) in the suspension of CD34$^+$ cells isolated from the marrow of transplanted NOD/SCID mice was determined by assessing the proportion of these progenitors that were inactivated (killed) by short term (20 min) or overnight (16 hour) exposure of the cells to 20 µg/ml of high specific activity $^3$H-thymidine (values represent the mean+/−the S.D. of data from up to four experiments with up to four mice per point in each). Significant in the results described in FIG. 9 is the observation that the analogs Compound A/SDF-1(1-14)-(G)$_4$-SDF-1(55-67)-Lys20/Glu24-cyclic amide (SEQ ID NO:809) and Compound L/SDF-1(1-14)-(G)$_4$-SDF-1(55-67) acid (SEQ ID NO:806) are as effective as native SDF-1 at inhibiting the proliferation of "primitive" human progenitor cells, as measured by the reduction of cells killed by exposure to high specific activity $^3$H-thymidine (which only affects proliferating cells).

Example 12

Figure 10:
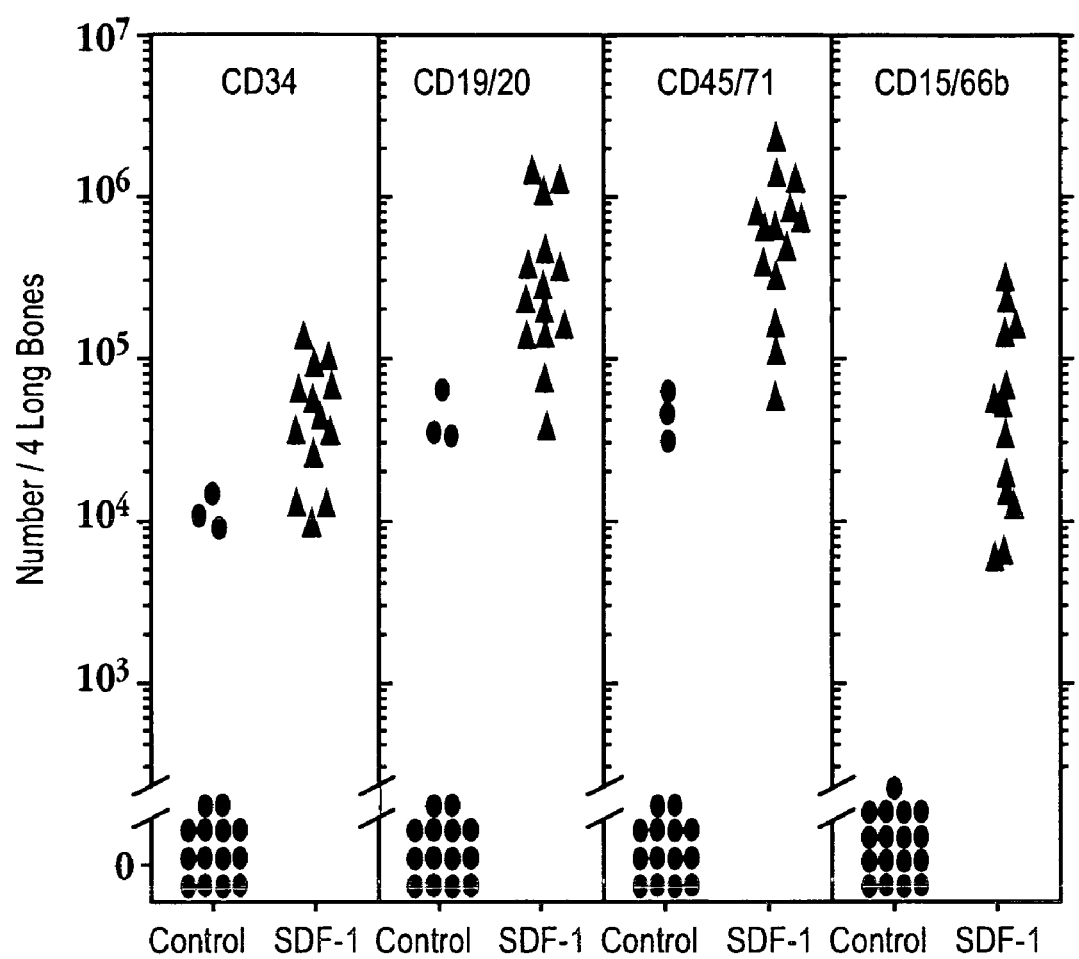
FIG. 10 shows data indicating that SDF-1 enhances the detectability of CRU (colony regenerating units) regenerated in NOD/SCID Mice transplanted with human fetal liver.

SDF-1 enhances the detectability of colony regenerating units (CRU) regenerated in NOD/SCID mice transplanted with human fetal liver cells (FIG. 10). Three to four NOD/SCID mice per group were sublethally irradiated and injected with human cells, in this case 10$^7$ light density fetal liver cells, and the mice then maintained for an interval of 2.5-3 weeks. As indicated, each group was then given 2 daily injections of either 10 µg of SDF-1, or an equivalent volume of control medium, and all mice were then sacrificed one day after the second injection. The bone marrow cells from each group were then pooled, and an aliquot removed for FACS analysis and overnight $^3$H-thymidine suicide assays to measure the cycling activity of the human CFC and LTC-IC (long term culture initiating culture) present. The remainder of the cells was injected into groups of 3-6 secondary recipients. These animals were then sacrificed 6 to 8 weeks later and their bone marrow removed and analyzed for the presence of human cells.

This example describes a secondary engraftment. When the bone marrow of the secondary recipients was evaluated, a considerable difference was observed in the level of human cells present in recipients of cells from the different groups of primary mice. As shown in FIG. 10, for SDF-1-injected mice, a far greater number of all types of human cells assessed was found in the marrow of the secondary recipients that had received marrow from primary mice treated with either SDF-1 by comparison to recipients of cells from media injected control primary mice.

Example 13

This example illustrates the effect of CXCR4 agonists such as SDF-1 and SDF-1 polypeptide analogs on the engraftment of human cells in human fetal liver transplanted NOD/SCID mice (FIG. 11). As shown in this figure, there was a lack of short-term effect of CXCR4 agonists on the frequency of different human cells present in NOD/SCID mice. In these experiments, 6 to 8 weeks post-transplanted mice were injected two times, one day apart with the test compound (SDF-1, Compound A/SDF-1(1-14)-(G)$_4$-SDF-1(55-67)-Lys20/Glu24-cyclic amide (SEQ ID NO:809) or Compound L/SDF-1(1-14)-(G)$_4$-SDF-1(55-67) acid (SEQ ID NO:806)) and sacrificed one day later. The frequency of the phenotypically defined human hematopoietic cells detected in the long bones (tibias and femurs) of mice was determined. Administration of 0.5 mg/kg of SDF-1 had no significant effect on the number of CD45/71, CD19/20, or CD34 cells, nor on the CFC or LTC-IC. In addition, none of the human cell types were detectably affected by this schedule of CXCR4 agonist administration. This data, coupled with that of FIGS. 9 and 10, indicates that SDF-1, SDF-1 analogs and other CXCR4 agonists may effectively augment secondary engraftment of human progenitor cells.

Example 14

Figure 12:
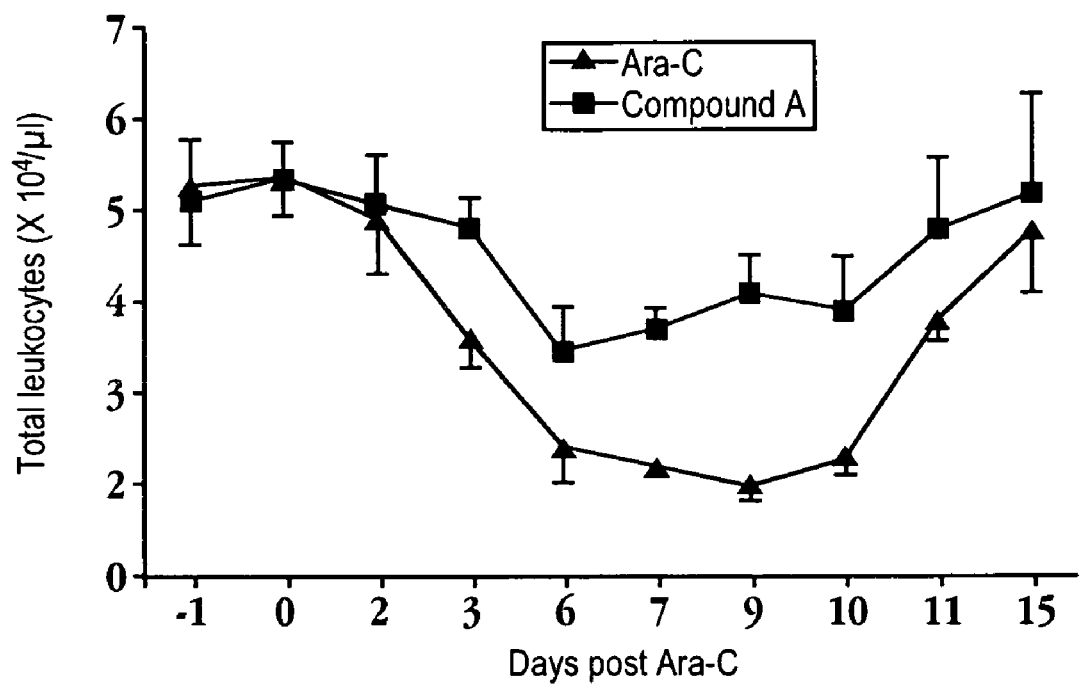
FIG. 12 shows the effect of Compound A (SEQ ID NO:809) (1 mg/kg, defined in the Examples) on the recovery of leukocytes following myeloablative chemotherapy with Ara-C (300 mg/kg). Mice were treated with Ara-C alone (Ara-C) or in combination with Compound A. The results represent the mean+/−one S.D. of 6 animals/group.

This example illustrates the effect of an SDF-1 polypeptide analog represented by SEQ ID NO:809 (10 mg/kg, identified as Compound A in FIG. 12) on the recovery of leukocytes following myeloablative chemotherapy with Ara-C (300 mg/kg). In the experiment described in the example, C3Hhen mice (female) were treated with 500 mg/kg Ara-C for two cycles—on days 0 and 10. During the second cycle of Ara-C dosing, Ara-C treated mice were injected with 10 mg/kg Compound A each day. A control was conducted with animals treated with Ara-C alone. Blood was collected from the tail vein into heparin-containing tubes at the onset of the experiment, and one day before every day following the second Ara-C dose. A total leukocyte count was determined. As shown in the graph of FIG. 12, the CXCR4 agonist Compound A acted to inhibit the cytotoxic effects of Ara-C and to sustain a higher level of leukocytes, illustrating the reversal of myelosuppressive effects of a chemotherapeutic regimen in vivo.

Example 15

Figure 13:
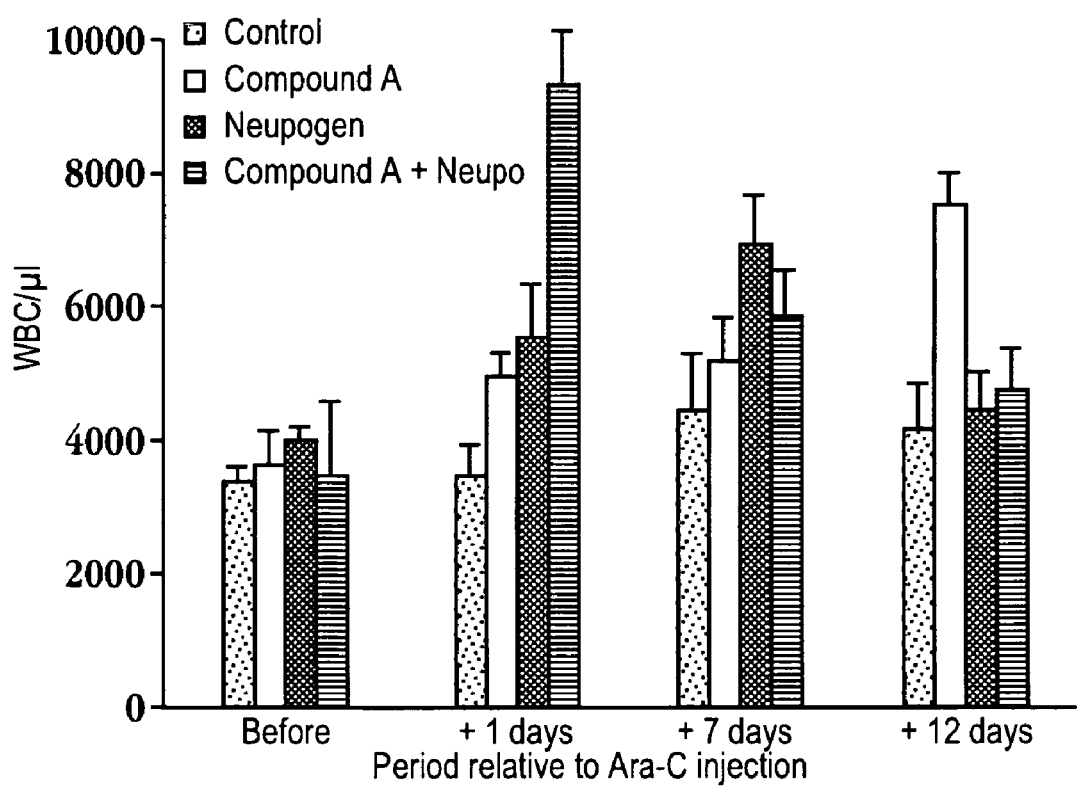
FIG. 13 shows the effect of Compound A (SEQ ID NO:809) (defined in Examples) and Neupogen® (G-CSF) on the growth of white blood cells in Ara-C treated mice. C3Hhen mice (female) were treated with 500 mg/kg Ara-C for two cycles—on days 0 and 10. During the second cycle of Ara-C dosing, Ara-C treated mice were injected with 10 mg/kg Compound A (SEQ ID NO:809), 10 mg/kg Neupogen®, alone or together (on days −1, 0, and 1 to 3). Control represents animals treated with Ara-C alone. Blood was collected from the tail vein into heparin-containing tubes at the onset of the experiment, and one day before and 1, 7 and 12 days following the second Ara-C dose. A total white blood cell count was obtained. The results represent the mean+/−one S.D. of 6 animals/group.

This example illustrates the effect of an SDF-1 polypeptide analog Compound A/SDF-1(1-14)-(G)$_4$-SDF-1(55-67)-Lys20/Glu24-cyclic amide (SEQ ID NO:809, 1 mg/kg) on the recovery of leukocytes following myeloablative chemotherapy with Ara-C (500 mg/kg) compared to G-CSF (Neupogen®) (FIG. 13). C3Hhen mice (female) were treated with 500 mg/kg Ara-C for two cycles—on days 0 and 10. During the second cycle of Ara-C dosing, Ara-C treated mice were injected with 10 mg/kg Compound A, 10 mg/kg Neupogen®, alone or together (on days −1, 0, and 1 to 3), with controls receiving no drug. Blood was collected from the tail vein into heparin-containing tubes at the onset of the experiment, and one day before and 1, 7 and 12 days following the second Ara-C dose. A total white blood cell count was obtained. The results in this example indicates that not only does treatment with Compound A enhance the recovery of white blood cells following myeloablative chemotherapy with Ara-C, co-treatment with the SDF-1 polypeptide analog and G-CSF (Neupogen®) resulted in a greater recovery compared the animals treated with G-CSF alone during the early treatment phase. Furthermore, the recovery following treatment with the SDF-1 polypeptide analog was sustained compared to the G-CSF treated animals.

Figure 14:
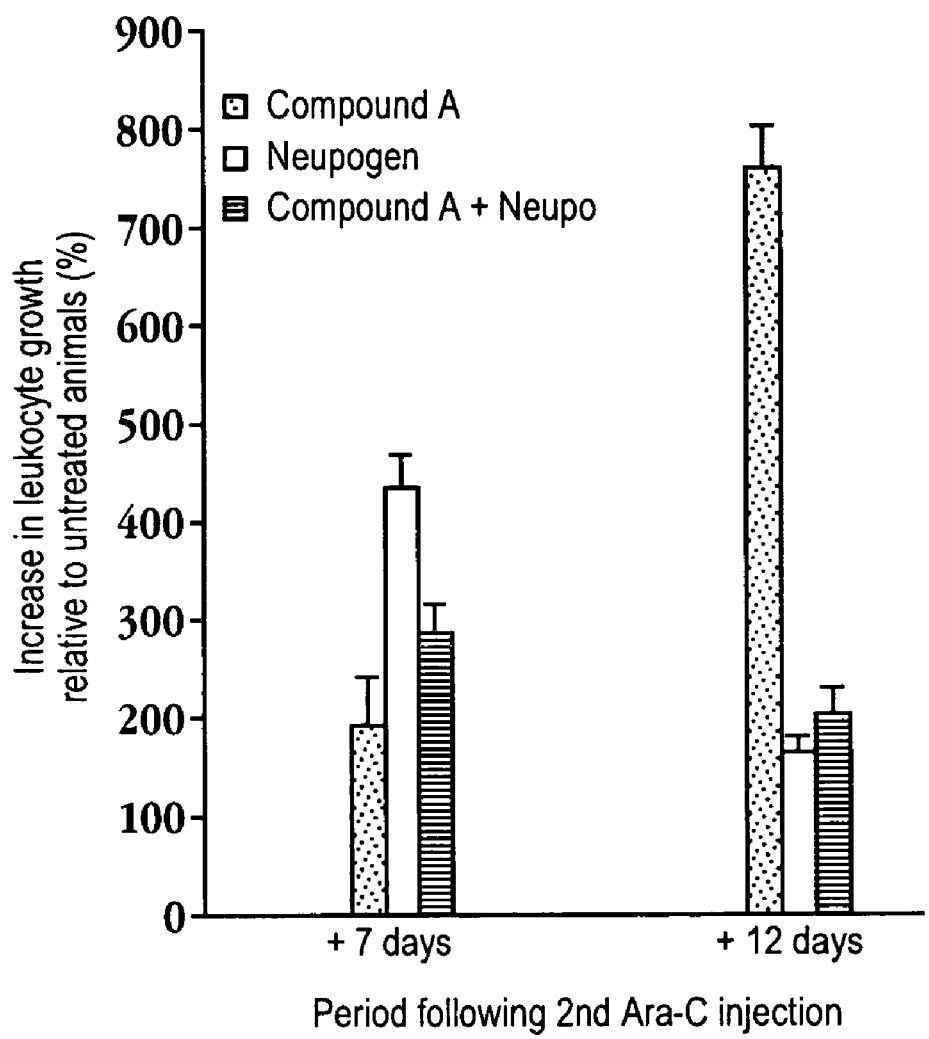
FIG. 14 shows the effect of Compound A (SEQ ID NO:809) and Neupogen® on the relative growth of white blood cells in Ara-C treated mice. C3Hhen mice (female) were treated with 500 mg/kg Ara-C for two cycles—on days 0 and 10. During the second cycle of Ara-C dosing, Ara-C treated mice were injected with 10 mg/kg Compound A (SEQ ID NO:809) (defined in Examples), 10 mg/kg Neupogen®, alone or together (on days −1, 0, and 1 to 3). Control represents animals treated with Ara-C alone. Blood was collected from the tail vein into heparin-containing tubes at the onset of the experiment, and one day before 7 and 12 days following the second Ara-C dose. A total white blood cell count was obtained. The increase in leukocytes (white blood cells) was determined relative to the number of cells counted the day before the second cycle Ara-C dose was administered. The results represent the mean+/−one S.D. of 6 animals/group.

FIG. 14 depicts the results of an experiment conducted under identical conditions, but the growth (increase in leukocyte count) relative to the number of cells counted in animals treated with Ara-C alone is illustrated. By twelve days following Ara-C administration, an approximately 7.5-fold increase in leukocytes was observed in mice treated with Compound A relative to animals treated with Ara-C alone, compared to 180% obtained in animals treated with Neupogen®.

Example 16

Table 8 shows the effect of the CXCR4 agonist, Compound A (SEQ ID NO:809), on the mobilization of leukocytes (neutrophils) in mice injected intravenously. Compound A was injected intravenously into Balb/C mice at 25 mg/kg. To obtain the data in Table 8, blood was collected through cardiac puncture and counted for the increase in white blood cells, and platelets.

TABLE 8

Effect of the SDF-1 agonist, Compound A, on the mobilization of leukocytes (neutrophils) in mice.

| Treatment day | Neutrophils ($10^9$/l) | Lymphocytes ($10^9$/l) | Platelets ($10^9$/l) |
|---|---|---|---|
| Day 0 (untreated) | 0.968 +/− 0.311 | 4.78 +/− 0.88 | 1099 +/− 50 |
| Day 2 (Compound A treated) | 3.159 +/− 0.761 | 3.15 +/− 1.075 | 1044 +/− 65 |
| Day 3 (Compound A treated) | 3.209 +/− 0.735 | 3.371 +/− 1.113 | 977 +/− 152 |
| Day 5 (Compound A treated) | 1.592 +/− 0.961 | 5.325 +/− 0.771 | 882 +/− 88 |
| Day 5 (untreated) | 0.893 +/− 0.371 | 6.540 +/− 0.970 | 937 +/− 169 |
| Day 8 (Compound A treated) | 2.513 +/− 2.733 | 4.072 +/− 1.386 | 1111 +/− 124 |

In Table 8, the Compound A peptide is represented by the structure set forth in SEQ ID NO:809.

These results demonstrate that CXCR-4 agonists, such as Compound A (SEQ ID NO:809), may be used to mobilize neutrophils (for example in patients undergoing chemotherapy to facilitate blood cell recovery). In this example, intravenous injection of the CXCR-agonist may facilitate the creation of an artificial chemotactic gradient, which may facilitate an immune response in the target tissue (in this case, blood). The gradient is established when the active therapeutic compound has pharmacokinetic characteristics that facilitate an appropriate residence time in the tissue into which the compound is administered, coupled with an appropriate susceptibility to degradation in vivo so that the concentration of the compound decreases away from the target tissue. In alternative embodiments, the invention therefore provides methods of treating a subject comprising administering to a target tissue a labile chemokine receptor agonist or antagonist so as to create an artificial chemotactic gradient. The agonist or antagonist may for example have a plasma half life of not more than 2 hours, as is the case with Compound A, or not more than 1, 3, 4, or 5 hours in alternative embodiments. One aspect of the invention provides a route of therapeutic chemokine administration which establishes an essentially uniform dosage of the chemokine receptor ligand in the target tissue, with a decreasing dosage of the chemokine radiating from the target tissue. For example, an inhaled aerosol formulation may be used to administer a labile chemokine receptor agonist or antagonist to the lung epithelium.

Example 17

Alternative embodiments of Compound A-like (SEQ ID NO:809) and Compound K-like (SEQ ID NO:803) SDF-1 analogs may include CXCR4 agonist peptides such as SDF-1-derived Glu24/Lys28-cyclic amide (Compound A-like) compounds having the formula

[RNH-Lys]Xaa$_1$-Val-Ser-Xaa$_2$-Ser-Tyr-Arg-Cys-Pro-Cys-Arg-Phe-Phe-[linker]-Leu-Lys-Trp-Ile-Gln-Glu-Tyr-Leu-Glu-Lys-Ala-Leu-Asn-NH$_2$ (SEQ ID NO:807); and SDF-1-derived Lys20/Glu24-cyclic acids (Compound K-like) compounds having the formula

[RCONH-Lys]Xaa$_1$-Val-Ser-Xaa$_2$ Ser-Tyr-Arg-Cys-Pro-Cys-Arg-Phe-Phe-[linker]-Leu-Lys-Trp-Ile-Gln-Glu-Tyr-Leu-Glu-Lys-Ala-Leu-Asn-NH$_2$ (SEQ ID NO:808).

In the foregoing peptides, R is a substituent that may for example be a hydrogen, alkyl, aryl or polyethyleneglycol (PEG) moiety; Xaa$_1$ is an amino acid that may for example be either an L-Proline or a D-Proline moiety; Xaa$_2$ is an amino acid that may for example be either a L-Leucine or a D-Leucine moiety; and [linker] is a moiety providing a covalent attachment between the N and C terminal portions of the peptides, such as a linking moiety having 4 glycines or NH$_2$—(CH2)$_n$—COOH (n=0-20). Examples of such compounds are shown in FIG. 17.

Example 18

Figure 16:
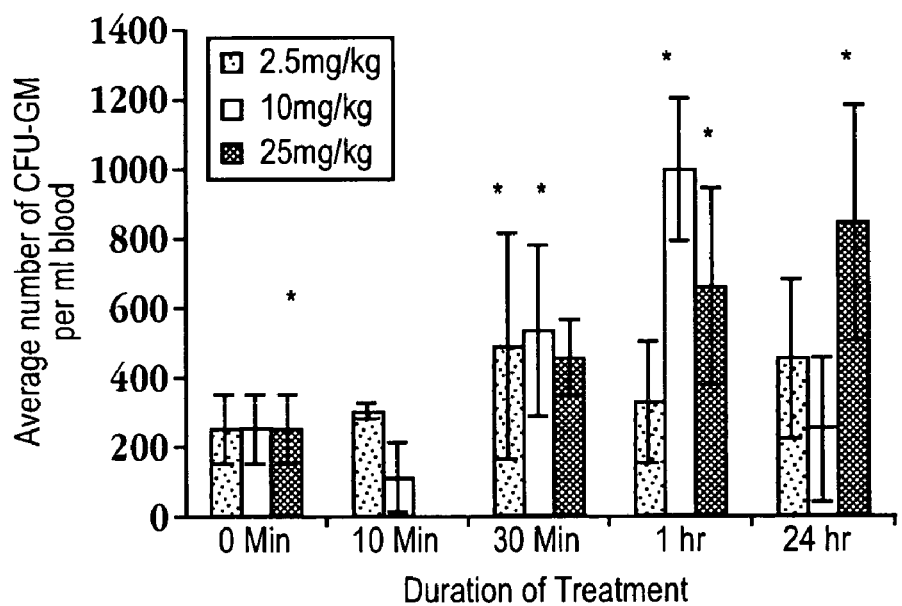
FIG. 16 shows a dose response curve for the mobilization of hematopoietic progenitor cells into the circulation in a mouse following treatment with Compound B (SEQ ID NO:810).

This example illustrates the efficacy of SDF-1 chemokine analog, Compound B (SEQ ID NO:810), in mobilization of hematopoietic progenitor cells into the circulation in a mouse model. A dose response curve is shown in FIG. 16. Briefly, female Balb/c mice of 18-21 g body weight were injected intravenously with 2.5, 10 or 25 mg/kg of Compound B (SEQ ID NO:810). The control consists of animals injected with saline. After 10 min, 1 h, 4 h and 24 h, blood was collected by cardiac puncture. Erythrocytes were lysed using ice cold ammonium chloride at nines the volume of the blood. After two washes with Iscove's Modified Dulbecco's Medium (Invitrogen, Burlington, Ontario, Canada) containing 2% fetal bovine serum (Invitrogen), an aliquot of cells were mixed with two times the volume of 3% acetic acid and the concentration of cells counted using a hemocytometer. The remaining cells were diluted to 1.5×10$^6$ cells/ml with IMDM containing 2% fetal bovine serum. 0.3 ml of cells was mixed with 3 ml MethoCult (Stem Cell Technologies, Vancouver, Canada). 1.1 ml of which was dispensed into each duplicate 35 mm culture dishes. Each pair was placed in a 100 mm petri dish with a third 35 mm dish containing 3 to 4 ml of sterile water and incubated at 37° C. and 5% CO$_2$ in a humidified incubator. After 10-12 days, the number of colony forming unit granulocyte-macrophage (CFU-GM) was counted in each plate and the data expressed as CFU/ml blood. The values in the figure represent the mean+/−one S.D. from a representative experiment. A time and concentration-dependent mobilization of hematopoietic progenitor cells into the circulation is illustrated, indicating the rapid and potent activity of the peptide analog.

The invention illustratively described herein can suitably be practiced in the absence of any element or elements, limitation or limitations that is not specifically disclosed herein. Thus, for example, the terms "comprising," "including," "containing," etc. shall be read expansively and without limitation. Additionally, the terms and expressions employed herein have been used as terms of description and not of limitation, and there is no intention in the use of such terms and expressions of excluding any equivalent of the invention shown or portion thereof, but it is recognized that various modifications are possible within the scope of the invention claimed. Thus, it should be understood that although the present invention has been specifically disclosed by preferred embodiments and optional features, modifications and variations of the inventions embodied herein disclosed can be readily made by those skilled in the art, and that such modifications and variations are considered to be within the scope of the inventions disclosed herein. The inventions have been described broadly and generically herein. Each of the narrower species and subgeneric groupings falling within the generic disclosure also form the part of these inventions. This includes within the generic description of each of the inventions a proviso or negative limitation that will allow removing any subject matter from the genus, regardless or whether or not the material to be removed was specifically recited. In addition, where features or aspects of an invention are described in terms of the Markush group, those schooled in the art will recognize that the invention is also thereby described in terms of any individual member or subgroup of members of the Markush group. Further, when a reference to an aspect of the invention lists a range of individual members, as for example, 'SEQ ID NO:9 to SEQ ID NO:162, inclusive,' it is intended to be equivalent to listing every member of the list individually, and additionally it should be understood that every individual member may be excluded or included in the claim individually.

The steps depicted and/or used in methods herein may be performed in a different order than as depicted and/or stated. The steps are merely exemplary of the order these steps may occur. The steps may occur in any order that is desired such that it still performs the goals of the claimed invention.

From the description of the invention herein, it is manifest that various equivalents can be used to implement the concepts of the present invention without departing from its scope. Moreover, while the invention has been described with specific reference to certain embodiments, a person of ordinary skill in the art would recognize that changes can be made in form and detail without departing from the spirit and the scope of the invention. The described embodiments are considered in all respects as illustrative and not restrictive. It should also be understood that the invention is not limited to the particular embodiments described herein, but is capable of many equivalents, rearrangements, modifications, and substitutions without departing from the scope of the invention. Thus, additional embodiments are within the scope of the invention and within the following claims.

Further, all patents and publications described herein are hereby incorporated by reference to the same extent as if each individual patent or publication was specifically and individually indicated to be incorporated by reference.

SEQUENCE LISTING (868 sequences)

SEQ ID NO: 1 - protein, 67 aa, Homo sapiens
KPVSLSYRCPCRFFESHVARANVKHLKILNTPNCALQIVARLKNNNRQVCIDPKLKWIQEYLEKALN

SEQ ID NO: 2 - protein, 69 aa, Homo sapiens
SLAADTPTACCFSYTSRQIPQNFIADYFETSSQCSKPGVIFLTKRSRQVCADPSEEWVQKYVSDLELSA

SEQ ID NO: 3 - protein, 93 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 4 - protein, 93 aa, Homo sapiens; identical to SEQ ID NO: 3

SEQ ID NO: 5 - protein, 31 aa, Artificial Sequence
  Synthetic peptide
  MOD_RES (2)..(2): D-Pro
  c-term may be amidated
KPVSLSYRCPCRFFGGGGLKWIQEYLEKALN

SEQ ID NO: 6 - protein, 14 aa, Artificial Sequence
  Synthetic peptide
  MOD_RES (2)..(2): D-Pro
KPVSLSYRCPCRFF

SEQ ID NO: 7 - protein, 31 aa, Artificial Sequence; identical to SEQ ID NO: 5
  Synthetic peptide
  c-term may be amidated

SEQ ID NO: 8 - protein, 14 aa, Artificial Sequence
  Synthetic peptide
  MOD_RES (5)..(5): D-Leu
KPVSLSYRCPCRFF

SEQ ID NO: 9 - protein, 31 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFXXXXLKWIQEYLEKALN

SEQ ID NO: 10 - protein, 31 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFXXXXLKWIQEYLEKALN

SEQ ID NO: 11 - protein, 31 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFXXXXLKWIQEYLEKALN

SEQ ID NO: 12 - protein, 31 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFXXXXLKWIQEYLEKALN

SEQ ID NO: 13 - protein, 31 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFXXXXLKWIQEYLEKALN

SEQ ID NO: 14 - protein, 31 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFXXXXLKWIQEYLEKALN

SEQ ID NO: 15 - protein, 31 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFXXXXLKWIQEYLEKALN

SEQ ID NO: 16 - protein, 31 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFXXXXLKWIQEYLEKALN

SEQ ID NO: 17 - protein, 31 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFXXXXLKWIQEYLEKALN

SEQ ID NO: 18 - protein, 31 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXXFFXXXXLKWIQEYLEKALN

SEQ ID NO: 19 - protein, 31 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXXFFXXXXLKWIQEYLEKALN

SEQ ID NO: 20 - protein, 31 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXXFFXXXXLKWIQEYLEKALN

SEQ ID NO: 21 - protein, 31 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXXFFXXXXLKWIQEYLEKALN

SEQ ID NO: 22 - protein, 31 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXXFFXXXXLKWIQEYLEKALN

SEQ ID NO: 23 - protein, 31 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXXFFXXXXLKWIQEYLEKALN

SEQ ID NO: 24 - protein, 31 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXXFFXXXXLKWIQEYLEKALN

SEQ ID NO: 25 - protein, 31 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXXFFXXXXLKWIQEYLEKALN

SEQ ID NO: 26 - protein, 31 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXXFFXXXXLKWIQEYLEKALN

SEQ ID NO: 27 - protein, 31 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXRXFXXXXLKWIQEYLEKALN

SEQ ID NO: 28 - protein, 31 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXRXFXXXXLKWIQEYLEKALN

SEQ ID NO: 29 - protein, 31 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXRXFXXXXLKWIQEYLEKALN

SEQ ID NO: 30 - protein, 31 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXRXFXXXXLKWIQEYLEKALN

SEQ ID NO: 31 - protein, 31 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXRXFXXXXLKWIQEYLEKALN

SEQ ID NO: 32 - protein, 31 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXRXFXXXXLKWIQEYLEKALN

SEQ ID NO: 33 - protein, 31 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXRXFXXXXLKWIQEYLEKALN

SEQ ID NO: 34 - protein, 31 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXRXFXXXXLKWIQEYLEKALN

SEQ ID NO: 35 - protein, 31 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXRXFXXXXLKWIQEYLEKALN

SEQ ID NO: 36 - protein, 31 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFXXXXXLKWIQEYLEKALN

SEQ ID NO: 37 - protein, 31 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFXXXXXLKWIQEYLEKALN

SEQ ID NO: 38 - protein, 31 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFXXXXXLKWIQEYLEKALN

SEQ ID NO: 39 - protein, 31 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFXXXXXLKWIQEYLEKALN

SEQ ID NO: 40 - protein, 31 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFXXXXXLKWIQEYLEKALN

SEQ ID NO: 41 - protein, 31 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFXXXXXLKWIQEYLEKALN

SEQ ID NO: 42 - protein, 31 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFXXXXXLKWIQEYLEKALN

SEQ ID NO: 43 - protein, 31 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFXXXXXLKWIQEYLEKALN

SEQ ID NO: 44 - protein, 31 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFXXXXXLKWIQEYLEKALN

SEQ ID NO: 45 - protein, 34 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFESHXXXXLKWIQEYLEKALN

SEQ ID NO: 46 - protein, 34 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFESHXXXXLKWIQEYLEKALN

SEQ ID NO: 47 - protein, 34 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFESHXXXXLKWIQEYLEKALN

SEQ ID NO: 48 - protein, 34 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFESHXXXXLKWIQEYLEKALN

SEQ ID NO: 49 - protein, 34 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFESHXXXXLKWIQEYLEKALN

SEQ ID NO: 50 - protein, 34 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFESHXXXXLKWIQEYLEKALN

SEQ ID NO: 51 - protein, 34 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFESHXXXXLKWIQEYLEKALN

SEQ ID NO: 52 - protein, 34 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFESHXXXXLKWIQEYLEKALN

SEQ ID NO: 53 - protein, 34 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFESHXXXXLKWIQEYLEKALN

SEQ ID NO: 54 - protein, 34 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXXFFESHXXXXLKWIQEYLEKALN

SEQ ID NO: 55 - protein, 34 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXXFFESHXXXXLKWIQEYLEKALN

SEQ ID NO: 56 - protein, 34 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXXFFESHXXXXLKWIQEYLEKALN

SEQ ID NO: 57 - protein, 34 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXXFFESHXXXXLKWIQEYLEKALN

SEQ ID NO: 58 - protein, 34 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXXFFESHXXXXLKWIQEYLEKALN

SEQ ID NO: 59 - protein, 34 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXXFFESHXXXXLKWIQEYLEKALN

SEQ ID NO: 60 - protein, 34 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXXFFESHXXXXLKWIQEYLEKALN

SEQ ID NO: 61 - protein, 34 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXXFFESHXXXXLKWIQEYLEKALN

SEQ ID NO: 62 - protein, 34 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXXFFESHXXXXLKWIQEYLEKALN

SEQ ID NO: 63 - protein, 34 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRXFESHXXXXLKWIQEYLEKALN

SEQ ID NO: 64 - protein, 34 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRXFESHXXXXLKWIQEYLEKALN

SEQ ID NO: 65 - protein, 34 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRXFESHXXXXLKWIQEYLEKALN

SEQ ID NO: 66 - protein, 34 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRXFESHXXXXLKWIQEYLEKALN

SEQ ID NO: 67 - protein, 34 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRXFESHXXXXLKWIQEYLEKALN

SEQ ID NO: 68 - protein, 34 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRXFESHXXXXLKWIQEYLEKALN

SEQ ID NO: 69 - protein, 34 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRXFESHXXXXLKWIQEYLEKALN

SEQ ID NO: 70 - protein, 34 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRXFESHXXXXLKWIQEYLEKALN

SEQ ID NO: 71 - protein, 34 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRXFESHXXXXLKWIQEYLEKALN

SEQ ID NO: 72 - protein, 34 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFXESHXXXXLKWIQEYLEKALN

SEQ ID NO: 73 - protein, 34 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFXESHXXXXLKWIQEYLEKALN

SEQ ID NO: 74 - protein, 34 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFXESHXXXXLKWIQEYLEKALN

SEQ ID NO: 75 - protein, 34 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFXESHXXXXLKWIQEYLEKALN

SEQ ID NO: 76 - protein, 34 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFXESHXXXXLKWIQEYLEKALN

SEQ ID NO: 77 - protein, 34 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFXESHXXXXLKWIQEYLEKALN

SEQ ID NO: 78 - protein, 34 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFXESHXXXXLKWIQEYLEKALN

SEQ ID NO: 79 - protein, 34 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFXESHXXXXLKWIQEYLEKALN

SEQ ID NO: 80 - protein, 34 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFXESHXXXXLKWIQEYLEKALN

SEQ ID NO: 81 - protein, 34 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFXSHXXXXLKWIQEYLEKALN

SEQ ID NO: 82 - protein, 34 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFXSHXXXXLKWIQEYLEKALN

SEQ ID NO: 83 - protein, 34 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFXSHXXXXLKWIQEYLEKALN

SEQ ID NO: 84 - protein, 34 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFXSHXXXXLKWIQEYLEKALN

SEQ ID NO: 85 - protein, 34 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFXSHXXXXLKWIQEYLEKALN

SEQ ID NO: 86 - protein, 34 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFXSHXXXXLKWIQEYLEKALN

SEQ ID NO: 87 - protein, 34 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFXSHXXXXLKWIQEYLEKALN

SEQ ID NO: 88 - protein, 34 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFXSHXXXXLKWIQEYLEKALN

SEQ ID NO: 89 - protein, 34 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFXSHXXXXLKWIQEYLEKALN

SEQ ID NO: 90 - protein, 34 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFEXHXXXXLKWIQEYLEKALN

SEQ ID NO: 91 - protein, 34 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFEXHXXXXLKWIQEYLEKALN

SEQ ID NO: 92 - protein, 34 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFEXHXXXXLKWIQEYLEKALN

SEQ ID NO: 93 - protein, 34 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFEXHXXXXLKWIQEYLEKALN

SEQ ID NO: 94 - protein, 34 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFEXHXXXXLKWIQEYLEKALN

SEQ ID NO: 95 - protein, 34 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFEXHXXXXLKWIQEYLEKALN

SEQ ID NO: 96 - protein, 34 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFEXHXXXXLKWIQEYLEKALN

SEQ ID NO: 97 - protein, 34 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFEXHXXXXLKWIQEYLEKALN

SEQ ID NO: 98 - protein, 34 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFEXHXXXXLKWIQEYLEKALN

SEQ ID NO: 99 - protein, 34 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFESXXXXXLKWIQEYLEKALN

SEQ ID NO: 100 - protein, 34 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFESXXXXXLKWIQEYLEKALN

SEQ ID NO: 101 - protein, 34 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFESXXXXXLKWIQEYLEKALN

SEQ ID NO: 102 - protein, 34 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFESXXXXXLKWIQEYLEKALN

SEQ ID NO: 103 - protein, 34 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFESXXXXXLKWIQEYLEKALN

SEQ ID NO: 104 - protein, 34 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFESXXXXXLKWIQEYLEKALN

SEQ ID NO: 105 - protein, 34 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFESXXXXXLKWIQEYLEKALN

SEQ ID NO: 106 - protein, 34 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFESXXXXXLKWIQEYLEKALN

SEQ ID NO: 107 - protein, 34 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFESXXXXXLKWIQEYLEKALN

SEQ ID NO: 108 - protein, 33 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFXXXXSKPGVIFLTKRSRQV

SEQ ID NO: 109 - protein, 33 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFXXXXSKPGVIFLTKRSRQV

SEQ ID NO: 110 - protein, 33 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFXXXXSKPGVIFLTKRSRQV

SEQ ID NO: 111 - protein, 33 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFXXXXSKPGVIFLTKRSRQV

SEQ ID NO: 112 - protein, 33 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFXXXXSKPGVIFLTKRSRQV

SEQ ID NO: 113 - protein, 33 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFXXXXSKPGVIFLTKRSRQV

SEQ ID NO: 114 - protein, 33 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFXXXXSKPGVIFLTKRSRQV

SEQ ID NO: 115 - protein, 33 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFXXXXSKPGVIFLTKRSRQV

SEQ ID NO: 116 - protein, 33 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFXXXXSKPGVIFLTKRSRQV

SEQ ID NO: 117 - protein, 33 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXXFFXXXXSKPGVIFLTKRSRQV

SEQ ID NO: 118 - protein, 33 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXXFFXXXXSKPGVIFLTKRSRQV

SEQ ID NO: 119 - protein, 33 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXXFFXXXXSKPGVIFLTKRSRQV

SEQ ID NO: 120 - protein, 33 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXXFFXXXXSKPGVIFLTKRSRQV

SEQ ID NO: 121 - protein, 33 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXXFFXXXXSKPGVIFLTKRSRQV

SEQ ID NO: 122 - protein, 33 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXXFFXXXXSKPGVIFLTKRSRQV

SEQ ID NO: 123 - protein, 33 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXXFFXXXXSKPGVIFLTKRSRQV

SEQ ID NO: 124 - protein, 33 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXXFFXXXXSKPGVIFLTKRSRQV

SEQ ID NO: 125 - protein, 33 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXXFFXXXXSKPGVIFLTKRSRQV

SEQ ID NO: 126 - protein, 33 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXRXFXXXXSKPGVIFLTKRSRQV

SEQ ID NO: 127 - protein, 33 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXRXFXXXXSKPGVIFLTKRSRQV

SEQ ID NO: 128 - protein, 33 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXRXFXXXXSKPGVIFLTKRSRQV

SEQ ID NO: 129 - protein, 33 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXRXFXXXXSKPGVIFLTKRSRQV

SEQ ID NO: 130 - protein, 33 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXRXFXXXXSKPGVIFLTKRSRQV

SEQ ID NO: 131 - protein, 33 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXRXFXXXXSKPGVIFLTKRSRQV

SEQ ID NO: 132 - protein, 33 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXRXFXXXXSKPGVIFLTKRSRQV

SEQ ID NO: 133 - protein, 33 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXRXFXXXXSKPGVIFLTKRSRQV

SEQ ID NO: 134 - protein, 33 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXRXFXXXXSKPGVIFLTKRSRQV

SEQ ID NO: 135 - protein, 33 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFXXXXXSKPGVIFLTKRSRQV

SEQ ID NO: 136 - protein, 33 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFXXXXXSKPGVIFLTKRSRQV

SEQ ID NO: 137 - protein, 33 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFXXXXXSKPGVIFLTKRSRQV

SEQ ID NO: 138 - protein, 33 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFXXXXXSKPGVIFLTKRSRQV

SEQ ID NO: 139 - protein, 33 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFXXXXXSKPGVIFLTKRSRQV

SEQ ID NO: 140 - protein, 33 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFXXXXXSKPGVIFLTKRSRQV

SEQ ID NO: 141 - protein, 33 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFXXXXXSKPGVIFLTKRSRQV

SEQ ID NO: 142 - protein, 33 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFXXXXXSKPGVIFLTKRSRQV

SEQ ID NO: 143 - protein, 33 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFXXXXXSKPGVIFLTKRSRQV

SEQ ID NO: 144 - protein, 33 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFXXXXEEWVQKYVDDLELSA

SEQ ID NO: 145 - protein, 33 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFXXXXEEWVQKYVDDLELSA

SEQ ID NO: 146 - protein, 33 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFXXXXEEWVQKYVDDLELSA

SEQ ID NO: 147 - protein, 33 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFXXXXEEWVQKYVDDLELSA

SEQ ID NO: 148 - protein, 33 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFXXXXEEWVQKYVDDLELSA

SEQ ID NO: 149 - protein, 33 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFXXXXEEWVQKYVDDLELSA

SEQ ID NO: 150 - protein, 33 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFXXXXEEWVQKYVDDLELSA

SEQ ID NO: 151 - protein, 33 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFXXXXEEWVQKYVDDLELSA

SEQ ID NO: 152 - protein, 33 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFXXXXEEWVQKYVDDLELSA

SEQ ID NO: 153 - protein, 33 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXXFFXXXXEEWVQKYVDDLELSA

SEQ ID NO: 154 - protein, 33 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXXFFXXXXEEWVQKYVDDLELSA

SEQ ID NO: 155 - protein, 33 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXXFFXXXXEEWVQKYVDDLELSA

SEQ ID NO: 156 - protein, 33 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXXFFXXXXEEWVQKYVDDLELSA

SEQ ID NO: 157 - protein, 33 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXXFFXXXXEEWVQKYVDDLELSA

SEQ ID NO: 158 - protein, 33 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXXFFXXXXEEWVQKYVDDLELSA

SEQ ID NO: 159 - protein, 33 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXXFFXXXXEEWVQKYVDDLELSA

SEQ ID NO: 160 - protein, 33 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXXFFXXXXEEWVQKYVDDLELSA

SEQ ID NO: 161 - protein, 31 aa, Artificial Sequence; identical to SEQ ID NO: 26
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 162 - protein, 33 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXRXFXXXXEEWVQKYVDDLELSA

SEQ ID NO: 163 - protein, 33 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXRXFXXXXEEWVQKYVDDLELSA

SEQ ID NO: 164 - protein, 33 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXRXFXXXXEEWVQKYVDDLELSA

SEQ ID NO: 165 - protein, 33 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXRXFXXXXEEWVQKYVDDLELSA

SEQ ID NO: 166 - protein, 33 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXRXFXXXXEEWVQKYVDDLELSA

SEQ ID NO: 167 - protein, 33 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXRXFXXXXEEWVQKYVDDLELSA

SEQ ID NO: 168 - protein, 33 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXRXFXXXXEEWVQKYVDDLELSA

SEQ ID NO: 169 - protein, 33 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXRXFXXXXEEWVQKYVDDLELSA

SEQ ID NO: 170 - protein, 33 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXRXFXXXXEEWVQKYVDDLELSA

SEQ ID NO: 171 - protein, 33 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFXXXXXEEWVQKYVDDLELSA

SEQ ID NO: 172 - protein, 33 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFXXXXXEEWVQKYVDDLELSA

SEQ ID NO: 173 - protein, 33 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFXXXXXEEWVQKYVDDLELSA

SEQ ID NO: 174 - protein, 33 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFXXXXXEEWVQKYVDDLELSA

SEQ ID NO: 175 - protein, 33 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFXXXXXEEWVQKYVDDLELSA

SEQ ID NO: 176 - protein, 33 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFXXXXXEEWVQKYVDDLELSA

SEQ ID NO: 177 - protein, 33 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFXXXXXEEWVQKYVDDLELSA

SEQ ID NO: 178 - protein, 33 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFXXXXXEEWVQKYVDDLELSA

SEQ ID NO: 179 - protein, 33 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFXXXXXEEWVQKYVDDLELSA

SEQ ID NO: 180 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFESHXXXXSKPGVIFLTKRSRQV

SEQ ID NO: 181 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFESHXXXXSKPGVIFLTKRSRQV

SEQ ID NO: 182 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFESHXXXXSKPGVIFLTKRSRQV

SEQ ID NO: 183 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFESHXXXXSKPGVIFLTKRSRQV

SEQ ID NO: 184 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFESHXXXXSKPGVIFLTKRSRQV

SEQ ID NO: 185 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFESHXXXXSKPGVIFLTKRSRQV

SEQ ID NO: 186 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFESHXXXXSKPGVIFLTKRSRQV

SEQ ID NO: 187 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFESHXXXXSKPGVIFLTKRSRQV

SEQ ID NO: 188 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFESHXXXXSKPGVIFLTKRSRQV

SEQ ID NO: 189 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXXFFESHXXXXSKPGVIFLTKRSRQV

SEQ ID NO: 190 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXXFFESHXXXXSKPGVIFLTKRSRQV

SEQ ID NO: 191 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXXFFESHXXXXSKPGVIFLTKRSRQV

SEQ ID NO: 192 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXXFFESHXXXXSKPGVIFLTKRSRQV

SEQ ID NO: 193 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXXFFESHXXXXSKPGVIFLTKRSRQV

SEQ ID NO: 194 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXXFFESHXXXXSKPGVIFLTKRSRQV

SEQ ID NO: 195 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXXFFESHXXXXSKPGVIFLTKRSRQV

SEQ ID NO: 196 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXXFFESHXXXXSKPGVIFLTKRSRQV

SEQ ID NO: 197 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXXFFESHXXXXSKPGVIFLTKRSRQV

SEQ ID NO: 198 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRXFESHXXXXSKPGVIFLTKRSRQV

SEQ ID NO: 199 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRXFESHXXXXSKPGVIFLTKRSRQV

SEQ ID NO: 200 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRXFESHXXXXSKPGVIFLTKRSRQV

SEQ ID NO: 201 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRXFESHXXXXSKPGVIFLTKRSRQV

SEQ ID NO: 202 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRXFESHXXXXSKPGVIFLTKRSRQV

SEQ ID NO: 203 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRXFESHXXXXSKPGVIFLTKRSRQV

SEQ ID NO: 204 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRXFESHXXXXSKPGVIFLTKRSRQV

SEQ ID NO: 205 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRXFESHXXXXSKPGVIFLTKRSRQV

SEQ ID NO: 206 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRXFESHXXXXSKPGVIFLTKRSRQV

SEQ ID NO: 207 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFXESHXXXXSKPGVIFLTKRSRQV

SEQ ID NO: 208 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFXESHXXXXSKPGVIFLTKRSRQV

SEQ ID NO: 209 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFXESHXXXXSKPGVIFLTKRSRQV

SEQ ID NO: 210 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFXESHXXXXSKPGVIFLTKRSRQV

SEQ ID NO: 211 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFXESHXXXXSKPGVIFLTKRSRQV

SEQ ID NO: 212 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFXESHXXXXSKPGVIFLTKRSRQV

SEQ ID NO: 213 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFXESHXXXXSKPGVIFLTKRSRQV

SEQ ID NO: 214 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFXESHXXXXSKPGVIFLTKRSRQV

SEQ ID NO: 215 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFXESHXXXXSKPGVIFLTKRSRQV

SEQ ID NO: 216 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFXSHXXXXSKPGVIFLTKRSRQV

SEQ ID NO: 217 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFXSHXXXXSKPGVIFLTKRSRQV

SEQ ID NO: 218 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFXSHXXXXSKPGVIFLTKRSRQV

SEQ ID NO: 219 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFXSHXXXXSKPGVIFLTKRSRQV

SEQ ID NO: 220 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFXSHXXXXSKPGVIFLTKRSRQV

SEQ ID NO: 221 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFXSHXXXXSKPGVIFLTKRSRQV

SEQ ID NO: 222 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFXSHXXXXSKPGVIFLTKRSRQV

SEQ ID NO: 223 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFXSHXXXXSKPGVIFLTKRSRQV

SEQ ID NO: 224 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFXSHXXXXSKPGVIFLTKRSRQV

SEQ ID NO: 225 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFEXHXXXXSKPGVIFLTKRSRQV

SEQ ID NO: 226 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFEXHXXXXSKPGVIFLTKRSRQV

SEQ ID NO: 227 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFEXHXXXXSKPGVIFLTKRSRQV

SEQ ID NO: 228 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFEXHXXXXSKPGVIFLTKRSRQV

SEQ ID NO: 229 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFEXHXXXXSKPGVIFLTKRSRQV

SEQ ID NO: 230 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFEXHXXXXSKPGVIFLTKRSRQV

SEQ ID NO: 231 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFEXHXXXXSKPGVIFLTKRSRQV

SEQ ID NO: 232 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFEXHXXXXSKPGVIFLTKRSRQV

SEQ ID NO: 233 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFEXHXXXXSKPGVIFLTKRSRQV

SEQ ID NO: 234 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFESXXXXXSKPGVIFLTKRSRQV

SEQ ID NO: 235 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFESXXXXXSKPGVIFLTKRSRQV

SEQ ID NO: 236 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFESXXXXXSKPGVIFLTKRSRQV

SEQ ID NO: 237 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFESXXXXXSKPGVIFLTKRSRQV

SEQ ID NO: 238 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFESXXXXXSKPGVIFLTKRSRQV

SEQ ID NO: 239 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFESXXXXXSKPGVIFLTKRSRQV

SEQ ID NO: 240 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFESXXXXXSKPGVIFLTKRSRQV

SEQ ID NO: 241 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFESXXXXXSKPGVIFLTKRSRQV

SEQ ID NO: 242 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFESXXXXXSKPGVIFLTKRSRQV

SEQ ID NO: 243 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFESHXXXXEEWVQKYVDDLELSA

SEQ ID NO: 244 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFESHXXXXEEWVQKYVDDLELSA

SEQ ID NO: 245 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFESHXXXXEEWVQKYVDDLELSA

SEQ ID NO: 246 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFESHXXXXEEWVQKYVDDLELSA

SEQ ID NO: 247 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFESHXXXXEEWVQKYVDDLELSA

SEQ ID NO: 248 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFESHXXXXEEWVQKYVDDLELSA

SEQ ID NO: 249 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFESHXXXXEEWVQKYVDDLELSA

SEQ ID NO: 250 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFESHXXXXEEWVQKYVDDLELSA

SEQ ID NO: 251 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFESHXXXXEEWVQKYVDDLELSA

SEQ ID NO: 252 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXXFFESHXXXXEEWVQKYVDDLELSA

SEQ ID NO: 253 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXXFFESHXXXXEEWVQKYVDDLELSA

SEQ ID NO: 254 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXXFFESHXXXXEEWVQKYVDDLELSA

SEQ ID NO: 255 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXXFFESHXXXXEEWVQKYVDDLELSA

SEQ ID NO: 256 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXXFFESHXXXXEEWVQKYVDDLELSA

SEQ ID NO: 257 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXXFFESHXXXXEEWVQKYVDDLELSA

SEQ ID NO: 258 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXXFFESHXXXXEEWVQKYVDDLELSA

SEQ ID NO: 259 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXXFFESHXXXXEEWVQKYVDDLELSA

SEQ ID NO: 260 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXXFFESHXXXXEEWVQKYVDDLELSA

SEQ ID NO: 261 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRXFESHXXXXEEWVQKYVDDLELSA

SEQ ID NO: 262 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRXFESHXXXXEEWVQKYVDDLELSA

SEQ ID NO: 263 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRXFESHXXXXEEWVQKYVDDLELSA

SEQ ID NO: 264 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRXFESHXXXXEEWVQKYVDDLELSA

SEQ ID NO: 265 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRXFESHXXXXEEWVQKYVDDLELSA

SEQ ID NO: 266 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRXFESHXXXXEEWVQKYVDDLELSA

SEQ ID NO: 267 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRXFESHXXXXEEWVQKYVDDLELSA

SEQ ID NO: 268 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRXFESHXXXXEEWVQKYVDDLELSA

SEQ ID NO: 269 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRXFESHXXXXEEWVQKYVDDLELSA

SEQ ID NO: 270 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFXESHXXXXEEWVQKYVDDLELSA

SEQ ID NO: 271 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFXESHXXXXEEWVQKYVDDLELSA

SEQ ID NO: 272 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFXESHXXXXEEWVQKYVDDLELSA

SEQ ID NO: 273 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFXESHXXXXEEWVQKYVDDLELSA

SEQ ID NO: 274 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFXESHXXXXEEWVQKYVDDLELSA

SEQ ID NO: 275 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFXESHXXXXEEWVQKYVDDLELSA

SEQ ID NO: 276 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFXESHXXXXEEWVQKYVDDLELSA

SEQ ID NO: 277 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFXESHXXXXEEWVQKYVDDLELSA

SEQ ID NO: 278 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFXESHXXXXEEWVQKYVDDLELSA

SEQ ID NO: 279 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFXSHXXXXEEWVQKYVDDLELSA

SEQ ID NO: 280 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFXSHXXXXEEWVQKYVDDLELSA

SEQ ID NO: 281 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFXSHXXXXEEWVQKYVDDLELSA

SEQ ID NO: 282 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFXSHXXXXEEWVQKYVDDLELSA

SEQ ID NO: 283 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFXSHXXXXEEWVQKYVDDLELSA

SEQ ID NO: 284 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFXSHXXXXEEWVQKYVDDLELSA

SEQ ID NO: 285 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFXSHXXXXEEWVQKYVDDLELSA

SEQ ID NO: 286 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFXSHXXXXEEWVQKYVDDLELSA

SEQ ID NO: 287 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFXSHXXXXEEWVQKYVDDLELSA

SEQ ID NO: 288 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFEXHXXXXEEWVQKYVDDLELSA

SEQ ID NO: 289 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFEXHXXXXEEWVQKYVDDLELSA

SEQ ID NO: 290 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFEXHXXXXEEWVQKYVDDLELSA

SEQ ID NO: 291 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFEXHXXXXEEWVQKYVDDLELSA

SEQ ID NO: 292 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFEXHXXXXEEWVQKYVDDLELSA

SEQ ID NO: 293 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFEXHXXXXEEWVQKYVDDLELSA

SEQ ID NO: 294 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFEXHXXXXEEWVQKYVDDLELSA

SEQ ID NO: 295 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFEXHXXXXEEWVQKYVDDLELSA

SEQ ID NO: 296 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFEXHXXXXEEWVQKYVDDLELSA

SEQ ID NO: 297 - protein, 36 aa, Artificial Sequence
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYRXPXRFFESXXXXXEEWVQKYVDDLELSA

SEQ ID NO: 298 - protein, 36 aa, Artificial Sequence
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPVSLSYRXPXRFFESXXXXXEEWVQKYVDDLELSA

SEQ ID NO: 299 - protein, 36 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXVSLSYRXPXRFFESXXXXXEEWVQKYVDDLELSA

SEQ ID NO: 300 - protein, 36 aa, Artificial Sequence
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPXSLSYRXPXRFFESXXXXXEEWVQKYVDDLELSA

SEQ ID NO: 301 - protein, 36 aa, Artificial Sequence
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVXLSYRXPXRFFESXXXXXEEWVQKYVDDLELSA

SEQ ID NO: 302 - protein, 36 aa, Artificial Sequence
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSXSYRXPXRFFESXXXXXEEWVQKYVDDLELSA

SEQ ID NO: 303 - protein, 36 aa, Artificial Sequence
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLXYRXPXRFFESXXXXXEEWVQKYVDDLELSA

SEQ ID NO: 304 - protein, 36 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFESXXXXXEEWVQKYVDDLELSA

SEQ ID NO: 305 - protein, 36 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KPVSLSYXXPXRFFESXXXXXEEWVQKYVDDLELSA

SEQ ID NO: 306 - protein, 31 aa, Artificial Sequence; identical to SEQ ID NO: 9
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 307 - protein, 31 aa, Artificial Sequence; identical to SEQ ID NO: 10
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 308 - protein, 31 aa, Artificial Sequence; identical to SEQ ID NO: 11
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 309 - protein, 31 aa, Artificial Sequence; identical to SEQ ID NO: 12
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 310 - protein, 31 aa, Artificial Sequence; identical to SEQ ID NO: 13
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 311 - protein, 31 aa, Artificial Sequence; identical to SEQ ID NO: 14
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 312 - protein, 31 aa, Artificial Sequence; identical to SEQ ID NO: 15
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 313 - protein, 62 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  MOD_RES (39)..(40): Any L- or D-natural amino acid and any non-natural amino acid; see specification as filed for detailed description of substitutions and preferred embodiments
  MOD_RES (42)..(42): Any L- or D-natural amino acid and any non-natural amino acid; see specification as filed for detailed description of substitutions and preferred embodiments
  MOD_RES (46)..(49): Any L- or D-natural or non-natural amino acid, and this range may     encompass 1 or 4 residues; see specification as filed for detailed  description of substitutions, R-groups and preferred emb
  c-term may be amidated
KPVSLSXRXPXRFFXXXXLKWIQEYLEKALNKPVSLSYXXPXRFFXXXXLKWIQEYLEKALN

SEQ ID NO: 314 - protein, 31 aa, Artificial Sequence; identical to SEQ ID NO: 17
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 315 - protein, 31 aa, Artificial Sequence; identical to SEQ ID NO: 18
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 316 - protein, 31 aa, Artificial Sequence; identical to SEQ ID NO: 19
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 317 - protein, 31 aa, Artificial Sequence; identical to SEQ ID NO: 20
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 318 - protein, 31 aa, Artificial Sequence; identical to SEQ ID NO: 21
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 319 - protein, 31 aa, Artificial Sequence; identical to SEQ ID NO: 22
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 320 - protein, 31 aa, Artificial Sequence; identical to SEQ ID NO: 23
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 321 - protein, 31 aa, Artificial Sequence; identical to SEQ ID NO: 24
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 322 - protein, 31 aa, Artificial Sequence; identical to SEQ ID NO: 25
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 323 - protein, 31 aa, Artificial Sequence; identical to SEQ ID NO: 26
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 324 - protein, 31 aa, Artificial Sequence; identical to SEQ ID NO: 27
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 325 - protein, 31 aa, Artificial Sequence; identical to SEQ ID NO: 28
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 326 - protein, 31 aa, Artificial Sequence; identical to SEQ ID NO: 29
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 327 - protein, 31 aa, Artificial Sequence; identical to SEQ ID NO: 30
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 328 - protein, 31 aa, Artificial Sequence; identical to SEQ ID NO: 31
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 329 - protein, 31 aa, Artificial Sequence; identical to SEQ ID NO: 32
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 330 - protein, 31 aa, Artificial Sequence; identical to SEQ ID NO: 33
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 331 - protein, 31 aa, Artificial Sequence; identical to SEQ ID NO: 34
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 332 - protein, 31 aa, Artificial Sequence; identical to SEQ ID NO: 35
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 333 - protein, 31 aa, Artificial Sequence; identical to SEQ ID NO: 36
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 334 - protein, 31 aa, Artificial Sequence; identical to SEQ ID NO: 37
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 335 - protein, 31 aa, Artificial Sequence; identical to SEQ ID NO: 38
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 336 - protein, 31 aa, Artificial Sequence; identical to SEQ ID NO: 39
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 337 - protein, 31 aa, Artificial Sequence; identical to SEQ ID NO: 40
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 338 - protein, 31 aa, Artificial Sequence; identical to SEQ ID NO: 41
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 339 - protein, 31 aa, Artificial Sequence; identical to SEQ ID NO: 42
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 340 - protein, 31 aa, Artificial Sequence; identical to SEQ ID NO: 43
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 341 - protein, 31 aa, Artificial Sequence; identical to SEQ ID NO: 44
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 342 - protein, 34 aa, Artificial Sequence; identical to SEQ ID NO: 45
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 343 - protein, 34 aa, Artificial Sequence; identical to SEQ ID NO: 46
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 344 - protein, 34 aa, Artificial Sequence; identical to SEQ ID NO: 47
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 345 - protein, 34 aa, Artificial Sequence; identical to SEQ ID NO: 48
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 346 - protein, 34 aa, Artificial Sequence; identical to SEQ ID NO: 49
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 347 - protein, 34 aa, Artificial Sequence; identical to SEQ ID NO: 50
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 348 - protein, 34 aa, Artificial Sequence; identical to SEQ ID NO: 51
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 349 - protein, 34 aa, Artificial Sequence; identical to SEQ ID NO: 52
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 350 - protein, 34 aa, Artificial Sequence; identical to SEQ ID NO: 53
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 351 - protein, 34 aa, Artificial Sequence; identical to SEQ ID NO: 54
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 352 - protein, 34 aa, Artificial Sequence; identical to SEQ ID NO: 55
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 353 - protein, 34 aa, Artificial Sequence; identical to SEQ ID NO: 56
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 354 - protein, 34 aa, Artificial Sequence; identical to SEQ ID NO: 57
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 355 - protein, 34 aa, Artificial Sequence; identical to SEQ ID NO: 58
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 356 - protein, 34 aa, Artificial Sequence; identical to SEQ ID NO: 59
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 357 - protein, 34 aa, Artificial Sequence; identical to SEQ ID NO: 60
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 358 - protein, 34 aa, Artificial Sequence; identical to SEQ ID NO: 61
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 359 - protein, 34 aa, Artificial Sequence; identical to SEQ ID NO: 62
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 360 - protein, 34 aa, Artificial Sequence; identical to SEQ ID NO: 63
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 361 - protein, 34 aa, Artificial Sequence; identical to SEQ ID NO: 64
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 362 - protein, 34 aa, Artificial Sequence; identical to SEQ ID NO: 65
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 363 - protein, 34 aa, Artificial Sequence; identical to SEQ ID NO: 66
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 364 - protein, 34 aa, Artificial Sequence; identical to SEQ ID NO: 67
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 365 - protein, 34 aa, Artificial Sequence; identical to SEQ ID NO: 68
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 366 - protein, 34 aa, Artificial Sequence; identical to SEQ ID NO: 69
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 367 - protein, 34 aa, Artificial Sequence; identical to SEQ ID NO: 70
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 368 - protein, 34 aa, Artificial Sequence; identical to SEQ ID NO: 71
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 369 - protein, 34 aa, Artificial Sequence; identical to SEQ ID NO: 72
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 370 - protein, 34 aa, Artificial Sequence; identical to SEQ ID NO: 73
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 371 - protein, 34 aa, Artificial Sequence; identical to SEQ ID NO: 74
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 372 - protein, 34 aa, Artificial Sequence; identical to SEQ ID NO: 75
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 373 - protein, 34 aa, Artificial Sequence; identical to SEQ ID NO: 76
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 374 - protein, 34 aa, Artificial Sequence; identical to SEQ ID NO: 77
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 375 - protein, 34 aa, Artificial Sequence; identical to SEQ ID NO: 78
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 376 - protein, 34 aa, Artificial Sequence; identical to SEQ ID NO: 79
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 377 - protein, 34 aa, Artificial Sequence; identical to SEQ ID NO: 80
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 378 - protein, 34 aa, Artificial Sequence; identical to SEQ ID NO: 81
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 379 - protein, 34 aa, Artificial Sequence; identical to SEQ ID NO: 82
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 380 - protein, 34 aa, Artificial Sequence; identical to SEQ ID NO: 83
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 381 - protein, 34 aa, Artificial Sequence; identical to SEQ ID NO: 84
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 382 - protein, 34 aa, Artificial Sequence; identical to SEQ ID NO: 85
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 383 - protein, 34 aa, Artificial Sequence; identical to SEQ ID NO: 86
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 384 - protein, 34 aa, Artificial Sequence; identical to SEQ ID NO: 87
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 385 - protein, 34 aa, Artificial Sequence; identical to SEQ ID NO: 88
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 386 - protein, 34 aa, Artificial Sequence; identical to SEQ ID NO: 89
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 387 - protein, 34 aa, Artificial Sequence; identical to SEQ ID NO: 90
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 388 - protein, 34 aa, Artificial Sequence; identical to SEQ ID NO: 91
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 389 - protein, 34 aa, Artificial Sequence; identical to SEQ ID NO: 92
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 390 - protein, 34 aa, Artificial Sequence; identical to SEQ ID NO: 93
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 391 - protein, 34 aa, Artificial Sequence; identical to SEQ ID NO: 94
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 392 - protein, 34 aa, Artificial Sequence; identical to SEQ ID NO: 95
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 393 - protein, 34 aa, Artificial Sequence; identical to SEQ ID NO: 96
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 394 - protein, 34 aa, Artificial Sequence; identical to SEQ ID NO: 97
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 395 - protein, 34 aa, Artificial Sequence; identical to SEQ ID NO: 98
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 396 - protein, 34 aa, Artificial Sequence; identical to SEQ ID NO: 99
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 397 - protein, 34 aa, Artificial Sequence; identical to SEQ ID NO: 100
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 398 - protein, 34 aa, Artificial Sequence; identical to SEQ ID NO: 101
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 399 - protein, 34 aa, Artificial Sequence; identical to SEQ ID NO: 102
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 400 - protein, 34 aa, Artificial Sequence; identical to SEQ ID NO: 103
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 401 - protein, 34 aa, Artificial Sequence; identical to SEQ ID NO: 104
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 402 - protein, 34 aa, Artificial Sequence; identical to SEQ ID NO: 105
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 403 - protein, 34 aa, Artificial Sequence; identical to SEQ ID NO: 106
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 404 - protein, 34 aa, Artificial Sequence; identical to SEQ ID NO: 107
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 405 - protein, 31 aa, Artificial Sequence; identical to SEQ ID NO: 9
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 406 - protein, 31 aa, Artificial Sequence; identical to SEQ ID NO: 10
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 407 - protein, 31 aa, Artificial Sequence; identical to SEQ ID NO: 11
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 408 - protein, 31 aa, Artificial Sequence; identical to SEQ ID NO: 12
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 409 - protein, 31 aa, Artificial Sequence; identical to SEQ ID NO: 13
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 410 - protein, 31 aa, Artificial Sequence; identical to SEQ ID NO: 14
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 411 - protein, 31 aa, Artificial Sequence; identical to SEQ ID NO: 15
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 412 - protein, 31 aa, Artificial Sequence; identical to SEQ ID NO: 16
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 413 - protein, 31 aa, Artificial Sequence; identical to SEQ ID NO: 17
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 414 - protein, 31 aa, Artificial Sequence; identical to SEQ ID NO: 18
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 415 - protein, 31 aa, Artificial Sequence; identical to SEQ ID NO: 19
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 416 - protein, 31 aa, Artificial Sequence; identical to SEQ ID NO: 20
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 417 - protein, 31 aa, Artificial Sequence; identical to SEQ ID NO: 21
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 418 - protein, 31 aa, Artificial Sequence; identical to SEQ ID NO: 22
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 419 - protein, 31 aa, Artificial Sequence; identical to SEQ ID NO: 23
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 420 - protein, 31 aa, Artificial Sequence; identical to SEQ ID NO: 24
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 421 - protein, 31 aa, Artificial Sequence; identical to SEQ ID NO: 25
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 422 - protein, 31 aa, Artificial Sequence; identical to SEQ ID NO: 26
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 423 - protein, 31 aa, Artificial Sequence; identical to SEQ ID NO: 27
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 424 - protein, 31 aa, Artificial Sequence; identical to SEQ ID NO: 28
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 425 - protein, 31 aa, Artificial Sequence; identical to SEQ ID NO: 29
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 426 - protein, 31 aa, Artificial Sequence; identical to SEQ ID NO: 30
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 427 - protein, 31 aa, Artificial Sequence; identical to SEQ ID NO: 31
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 428 - protein, 31 aa, Artificial Sequence; identical to SEQ ID NO: 32
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 429 - protein, 31 aa, Artificial Sequence; identical to SEQ ID NO: 33
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 430 - protein, 31 aa, Artificial Sequence; identical to SEQ ID NO: 34
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 431 - protein, 31 aa, Artificial Sequence; identical to SEQ ID NO: 35
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 432 - protein, 31 aa, Artificial Sequence; identical to SEQ ID NO: 36
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 433 - protein, 31 aa, Artificial Sequence; identical to SEQ ID NO: 37
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 434 - protein, 31 aa, Artificial Sequence; identical to SEQ ID NO: 38
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 435 - protein, 31 aa, Artificial Sequence; identical to SEQ ID NO: 39
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 436 - protein, 31 aa, Artificial Sequence; identical to SEQ ID NO: 40
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 437 - protein, 31 aa, Artificial Sequence; identical to SEQ ID NO: 41
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 438 - protein, 31 aa, Artificial Sequence; identical to SEQ ID NO: 42
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 439 - protein, 31 aa, Artificial Sequence; identical to SEQ ID NO: 43
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 440 - protein, 31 aa, Artificial Sequence; identical to SEQ ID NO: 44
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 441 - protein, 34 aa, Artificial Sequence; identical to SEQ ID NO: 45
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 442 - protein, 34 aa, Artificial Sequence; identical to SEQ ID NO: 46
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 443 - protein, 34 aa, Artificial Sequence; identical to SEQ ID NO: 47
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 444 - protein, 34 aa, Artificial Sequence; identical to SEQ ID NO: 48
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 445 - protein, 34 aa, Artificial Sequence; identical to SEQ ID NO: 49
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 446 - protein, 34 aa, Artificial Sequence; identical to SEQ ID NO: 50
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 447 - protein, 34 aa, Artificial Sequence; identical to SEQ ID NO: 51
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 448 - protein, 34 aa, Artificial Sequence; identical to SEQ ID NO: 52
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 449 - protein, 34 aa, Artificial Sequence; identical to SEQ ID NO: 53
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 450 - protein, 34 aa, Artificial Sequence; identical to SEQ ID NO: 54
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 451 - protein, 34 aa, Artificial Sequence; identical to SEQ ID NO: 55
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 452 - protein, 34 aa, Artificial Sequence; identical to SEQ ID NO: 56
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 453 - protein, 34 aa, Artificial Sequence; identical to SEQ ID NO: 57
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 454 - protein, 34 aa, Artificial Sequence; identical to SEQ ID NO: 58
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 455 - protein, 34 aa, Artificial Sequence; identical to SEQ ID NO: 59
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 456 - protein, 34 aa, Artificial Sequence; identical to SEQ ID NO: 60
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 457 - protein, 68 aa, Artificial Sequence
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  MOD_RES (42)..(43): Any L- or D-natural amino acid and any non-natural amino acid; see specification as filed for detailed description of substitutions and preferred embodiments
  MOD_RES (45)..(46): Any L- or D-natural amino acid and any non-natural amino acid; see specification as filed for detailed description of substitutions and preferred embodiments
  MOD_RES (52)..(55): Any L- or D-natural or non-natural amino acid, and this range may     encompass 1 or 4 residues; see specification as filed for detailed  description of substitutions, R-groups and preferred emb
  c-term may be amidated
KPVSLSXRXPXXFFESHXXXXLKWIQEYLEKALNKPVSLSYXXPXXFFESHXXXXLKWIQEYLEKALN

SEQ ID NO: 458 - protein, 34 aa, Artificial Sequence; identical to SEQ ID NO: 62
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 459 - protein, 34 aa, Artificial Sequence; identical to SEQ ID NO: 63
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 460 - protein, 34 aa, Artificial Sequence; identical to SEQ ID NO: 64
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 461 - protein, 34 aa, Artificial Sequence; identical to SEQ ID NO: 65
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 462 - protein, 34 aa, Artificial Sequence; identical to SEQ ID NO: 66
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 463 - protein, 34 aa, Artificial Sequence; identical to SEQ ID NO: 67
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 464 - protein, 34 aa, Artificial Sequence; identical to SEQ ID NO: 68
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 465 - protein, 34 aa, Artificial Sequence; identical to SEQ ID NO: 69
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 466 - protein, 34 aa, Artificial Sequence; identical to SEQ ID NO: 70
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 467 - protein, 34 aa, Artificial Sequence; identical to SEQ ID NO: 71
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 468 - protein, 34 aa, Artificial Sequence; identical to SEQ ID NO: 72
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 469 - protein, 34 aa, Artificial Sequence; identical to SEQ ID NO: 73
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 470 - protein, 34 aa, Artificial Sequence; identical to SEQ ID NO: 74
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 471 - protein, 34 aa, Artificial Sequence; identical to SEQ ID NO: 75
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 472 - protein, 34 aa, Artificial Sequence; identical to SEQ ID NO: 76
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 473 - protein, 34 aa, Artificial Sequence; identical to SEQ ID NO: 77
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 474 - protein, 34 aa, Artificial Sequence; identical to SEQ ID NO: 78
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 475 - protein, 34 aa, Artificial Sequence; identical to SEQ ID NO: 79
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 476 - protein, 34 aa, Artificial Sequence; identical to SEQ ID NO: 80
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 477 - protein, 34 aa, Artificial Sequence; identical to SEQ ID NO: 81
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 478 - protein, 34 aa, Artificial Sequence; identical to SEQ ID NO: 82
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 479 - protein, 34 aa, Artificial Sequence; identical to SEQ ID NO: 83
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 480 - protein, 34 aa, Artificial Sequence; identical to SEQ ID NO: 84
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 481 - protein, 34 aa, Artificial Sequence; identical to SEQ ID NO: 85
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 482 - protein, 34 aa, Artificial Sequence; identical to SEQ ID NO: 86
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 483 - protein, 34 aa, Artificial Sequence; identical to SEQ ID NO: 87
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 484 - protein, 34 aa, Artificial Sequence; identical to SEQ ID NO: 88
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 485 - protein, 34 aa, Artificial Sequence; identical to SEQ ID NO: 89
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 486 - protein, 34 aa, Artificial Sequence; identical to SEQ ID NO: 90
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 487 - protein, 34 aa, Artificial Sequence; identical to SEQ ID NO: 91
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 488 - protein, 34 aa, Artificial Sequence; identical to SEQ ID NO: 92
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 489 - protein, 34 aa, Artificial Sequence; identical to SEQ ID NO: 93
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 490 - protein, 34 aa, Artificial Sequence; identical to SEQ ID NO: 94
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 491 - protein, 34 aa, Artificial Sequence; identical to SEQ ID NO: 95
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 492 - protein, 34 aa, Artificial Sequence; identical to SEQ ID NO: 96
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 493 - protein, 34 aa, Artificial Sequence; identical to SEQ ID NO: 97
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 494 - protein, 34 aa, Artificial Sequence; identical to SEQ ID NO: 98
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 495 - protein, 34 aa, Artificial Sequence; identical to SEQ ID NO: 99
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 496 - protein, 34 aa, Artificial Sequence; identical to SEQ ID NO: 100
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 497 - protein, 34 aa, Artificial Sequence; identical to SEQ ID NO: 101
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 498 - protein, 34 aa, Artificial Sequence; identical to SEQ ID NO: 102
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 499 - protein, 34 aa, Artificial Sequence; identical to SEQ ID NO: 103
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 500 - protein, 34 aa, Artificial Sequence; identical to SEQ ID NO: 104
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 501 - protein, 34 aa, Artificial Sequence; identical to SEQ ID NO: 105
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 502 - protein, 34 aa, Artificial Sequence; identical to SEQ ID NO: 106
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 503 - protein, 34 aa, Artificial Sequence; identical to SEQ ID NO: 107
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 504 - protein, 33 aa, Artificial Sequence; identical to SEQ ID NO: 108
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 505 - protein, 33 aa, Artificial Sequence; identical to SEQ ID NO: 109
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 506 - protein, 33 aa, Artificial Sequence; identical to SEQ ID NO: 110
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 507 - protein, 33 aa, Artificial Sequence; identical to SEQ ID NO: 111
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 508 - protein, 33 aa, Artificial Sequence; identical to SEQ ID NO: 112
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 509 - protein, 33 aa, Artificial Sequence; identical to SEQ ID NO: 113
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 510 - protein, 33 aa, Artificial Sequence; identical to SEQ ID NO: 114
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 511 - protein, 33 aa, Artificial Sequence; identical to SEQ ID NO: 115
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 512 - protein, 33 aa, Artificial Sequence; identical to SEQ ID NO: 116
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 513 - protein, 33 aa, Artificial Sequence; identical to SEQ ID NO: 117
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 514 - protein, 33 aa, Artificial Sequence; identical to SEQ ID NO: 118
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 515 - protein, 33 aa, Artificial Sequence; identical to SEQ ID NO: 119
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 516 - protein, 33 aa, Artificial Sequence; identical to SEQ ID NO: 120
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 517 - protein, 33 aa, Artificial Sequence; identical to SEQ ID NO: 121
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 518 - protein, 33 aa, Artificial Sequence; identical to SEQ ID NO: 122
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 519 - protein, 33 aa, Artificial Sequence; identical to SEQ ID NO: 123
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 520 - protein, 33 aa, Artificial Sequence; identical to SEQ ID NO: 124
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 521 - protein, 33 aa, Artificial Sequence; identical to SEQ ID NO: 125
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 522 - protein, 33 aa, Artificial Sequence; identical to SEQ ID NO: 126
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 523 - protein, 33 aa, Artificial Sequence; identical to SEQ ID NO: 127
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 524 - protein, 33 aa, Artificial Sequence; identical to SEQ ID NO: 128
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 525 - protein, 33 aa, Artificial Sequence; identical to SEQ ID NO: 129
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 526 - protein, 33 aa, Artificial Sequence; identical to SEQ ID NO: 130
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 527 - protein, 33 aa, Artificial Sequence; identical to SEQ ID NO: 131
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 528 - protein, 33 aa, Artificial Sequence; identical to SEQ ID NO: 132
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 529 - protein, 33 aa, Artificial Sequence; identical to SEQ ID NO: 133
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 530 - protein, 33 aa, Artificial Sequence; identical to SEQ ID NO: 134
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 531 - protein, 33 aa, Artificial Sequence; identical to SEQ ID NO: 135
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 532 - protein, 33 aa, Artificial Sequence; identical to SEQ ID NO: 136
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 533 - protein, 33 aa, Artificial Sequence; identical to SEQ ID NO: 137
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 534 - protein, 33 aa, Artificial Sequence; identical to SEQ ID NO: 138
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 535 - protein, 33 aa, Artificial Sequence; identical to SEQ ID NO: 139
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 536 - protein, 33 aa, Artificial Sequence; identical to SEQ ID NO: 140
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 537 - protein, 33 aa, Artificial Sequence; identical to SEQ ID NO: 141
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 538 - protein, 33 aa, Artificial Sequence; identical to SEQ ID NO: 142
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 539 - protein, 33 aa, Artificial Sequence; identical to SEQ ID NO: 143
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 540 - protein, 36 aa, Artificial Sequence; identical to SEQ ID NO: 180
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 541 - protein, 36 aa, Artificial Sequence; identical to SEQ ID NO: 181
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 542 - protein, 36 aa, Artificial Sequence; identical to SEQ ID NO: 182
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 543 - protein, 36 aa, Artificial Sequence; identical to SEQ ID NO: 183
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 544 - protein, 36 aa, Artificial Sequence; identical to SEQ ID NO: 184
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 545 - protein, 36 aa, Artificial Sequence; identical to SEQ ID NO: 185
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 546 - protein, 36 aa, Artificial Sequence; identical to SEQ ID NO: 186
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 547 - protein, 36 aa, Artificial Sequence; identical to SEQ ID NO: 187
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 548 - protein, 36 aa, Artificial Sequence; identical to SEQ ID NO: 188
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 549 - protein, 36 aa, Artificial Sequence; identical to SEQ ID NO: 189
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 550 - protein, 36 aa, Artificial Sequence; identical to SEQ ID NO: 190
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 551 - protein, 36 aa, Artificial Sequence; identical to SEQ ID NO: 191
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 552 - protein, 36 aa, Artificial Sequence; identical to SEQ ID NO: 192
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 553 - protein, 36 aa, Artificial Sequence; identical to SEQ ID NO: 193
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 554 - protein, 36 aa, Artificial Sequence; identical to SEQ ID NO: 194
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 555 - protein, 36 aa, Artificial Sequence; identical to SEQ ID NO: 195
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 556 - protein, 36 aa, Artificial Sequence; identical to SEQ ID NO: 196
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 557 - protein, 36 aa, Artificial Sequence; identical to SEQ ID NO: 197
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 558 - protein, 36 aa, Artificial Sequence; identical to SEQ ID NO: 198
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 559 - protein, 36 aa, Artificial Sequence; identical to SEQ ID NO: 199
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 560 - protein, 36 aa, Artificial Sequence; identical to SEQ ID NO: 200
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 561 - protein, 36 aa, Artificial Sequence; identical to SEQ ID NO: 201
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 562 - protein, 36 aa, Artificial Sequence; identical to SEQ ID NO: 202
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 563 - protein, 36 aa, Artificial Sequence; identical to SEQ ID NO: 203
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 564 - protein, 36 aa, Artificial Sequence; identical to SEQ ID NO: 204
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 565 - protein, 36 aa, Artificial Sequence; identical to SEQ ID NO: 205
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 566 - protein, 36 aa, Artificial Sequence; identical to SEQ ID NO: 206
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 567 - protein, 36 aa, Artificial Sequence; identical to SEQ ID NO: 207
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 568 - protein, 36 aa, Artificial Sequence; identical to SEQ ID NO: 208
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 569 - protein, 36 aa, Artificial Sequence; identical to SEQ ID NO: 209
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 570 - protein, 36 aa, Artificial Sequence; identical to SEQ ID NO: 210
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 571 - protein, 36 aa, Artificial Sequence; identical to SEQ ID NO: 211
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 572 - protein, 36 aa, Artificial Sequence; identical to SEQ ID NO: 212
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 573 - protein, 36 aa, Artificial Sequence; identical to SEQ ID NO: 213
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 574 - protein, 36 aa, Artificial Sequence; identical to SEQ ID NO: 214
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 575 - protein, 36 aa, Artificial Sequence; identical to SEQ ID NO: 215
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 576 - protein, 36 aa, Artificial Sequence; identical to SEQ ID NO: 216
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 577 - protein, 36 aa, Artificial Sequence; identical to SEQ ID NO: 217
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 578 - protein, 36 aa, Artificial Sequence; identical to SEQ ID NO: 218
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 579 - protein, 36 aa, Artificial Sequence; identical to SEQ ID NO: 219
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 580 - protein, 36 aa, Artificial Sequence; identical to SEQ ID NO: 220
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 581 - protein, 36 aa, Artificial Sequence; identical to SEQ ID NO: 221
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 582 - protein, 36 aa, Artificial Sequence; identical to SEQ ID NO: 222
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 583 - protein, 36 aa, Artificial Sequence; identical to SEQ ID NO: 223
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 584 - protein, 36 aa, Artificial Sequence; identical to SEQ ID NO: 224
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 585 - protein, 36 aa, Artificial Sequence; identical to SEQ ID NO: 225
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 586 - protein, 36 aa, Artificial Sequence; identical to SEQ ID NO: 226
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 587 - protein, 36 aa, Artificial Sequence; identical to SEQ ID NO: 227
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 588 - protein, 36 aa, Artificial Sequence; identical to SEQ ID NO: 228
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 589 - protein, 36 aa, Artificial Sequence; identical to SEQ ID NO: 229
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 590 - protein, 36 aa, Artificial Sequence; identical to SEQ ID NO: 230
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 591 - protein, 36 aa, Artificial Sequence; identical to SEQ ID NO: 231
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 592 - protein, 36 aa, Artificial Sequence; identical to SEQ ID NO: 232
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 593 - protein, 36 aa, Artificial Sequence; identical to SEQ ID NO: 233
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 594 - protein, 36 aa, Artificial Sequence; identical to SEQ ID NO: 234
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 595 - protein, 36 aa, Artificial Sequence; identical to SEQ ID NO: 235
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 596 - protein, 36 aa, Artificial Sequence; identical to SEQ ID NO: 236
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 597 - protein, 36 aa, Artificial Sequence; identical to SEQ ID NO: 237
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 598 - protein, 36 aa, Artificial Sequence; identical to SEQ ID NO: 238
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 599 - protein, 36 aa, Artificial Sequence; identical to SEQ ID NO: 239
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 600 - protein, 36 aa, Artificial Sequence; identical to SEQ ID NO: 240
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 601 - protein, 36 aa, Artificial Sequence; identical to SEQ ID NO: 241
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 602 - protein, 36 aa, Artificial Sequence; identical to SEQ ID NO: 242
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 603 - protein, 33 aa, Artificial Sequence; identical to SEQ ID NO: 144
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 604 - protein, 33 aa, Artificial Sequence; identical to SEQ ID NO: 145
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 605 - protein, 33 aa, Artificial Sequence; identical to SEQ ID NO: 146
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 606 - protein, 33 aa, Artificial Sequence; identical to SEQ ID NO: 147
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 607 - protein, 33 aa, Artificial Sequence; identical to SEQ ID NO: 148
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 608 - protein, 33 aa, Artificial Sequence; identical to SEQ ID NO: 149
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 609 - protein, 33 aa, Artificial Sequence; identical to SEQ ID NO: 150
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 610 - protein, 33 aa, Artificial Sequence; identical to SEQ ID NO: 151
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 611 - protein, 33 aa, Artificial Sequence; identical to SEQ ID NO: 152
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 612 - protein, 33 aa, Artificial Sequence; identical to SEQ ID NO: 153
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 613 - protein, 33 aa, Artificial Sequence; identical to SEQ ID NO: 154
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 614 - protein, 33 aa, Artificial Sequence; identical to SEQ ID NO: 155
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 615 - protein, 33 aa, Artificial Sequence; identical to SEQ ID NO: 156
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 616 - protein, 33 aa, Artificial Sequence; identical to SEQ ID NO: 157
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 617 - protein, 33 aa, Artificial Sequence; identical to SEQ ID NO: 158
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 618 - protein, 33 aa, Artificial Sequence; identical to SEQ ID NO: 159
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 619 - protein, 33 aa, Artificial Sequence; identical to SEQ ID NO: 160
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 620 - protein, 33 aa, Artificial Sequence
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KPVSLSYXXPXXFFXXXXEEWVQKYVDDLELSA

SEQ ID NO: 621 - protein, 33 aa, Artificial Sequence; identical to SEQ ID NO: 162
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 622 - protein, 33 aa, Artificial Sequence; identical to SEQ ID NO: 163
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 623 - protein, 33 aa, Artificial Sequence; identical to SEQ ID NO: 164
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 624 - protein, 33 aa, Artificial Sequence; identical to SEQ ID NO: 165
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 625 - protein, 33 aa, Artificial Sequence; identical to SEQ ID NO: 166
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 626 - protein, 33 aa, Artificial Sequence; identical to SEQ ID NO: 167
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 627 - protein, 33 aa, Artificial Sequence; identical to SEQ ID NO: 168
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 628 - protein, 33 aa, Artificial Sequence; identical to SEQ ID NO: 169
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 629 - protein, 33 aa, Artificial Sequence; identical to SEQ ID NO: 170
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 630 - protein, 33 aa, Artificial Sequence; identical to SEQ ID NO: 171
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 631 - protein, 33 aa, Artificial Sequence; identical to SEQ ID NO: 172
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 632 - protein, 33 aa, Artificial Sequence; identical to SEQ ID NO: 173
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 633 - protein, 33 aa, Artificial Sequence; identical to SEQ ID NO: 174
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 634 - protein, 33 aa, Artificial Sequence; identical to SEQ ID NO: 175
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 635 - protein, 33 aa, Artificial Sequence; identical to SEQ ID NO: 176
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 636 - protein, 33 aa, Artificial Sequence; identical to SEQ ID NO: 177
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 637 - protein, 33 aa, Artificial Sequence; identical to SEQ ID NO: 178
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 638 - protein, 33 aa, Artificial Sequence; identical to SEQ ID NO: 179
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 639 - protein, 36 aa, Artificial Sequence; identical to SEQ ID NO: 243
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 640 - protein, 36 aa, Artificial Sequence; identical to SEQ ID NO: 244
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 641 - protein, 36 aa, Artificial Sequence; identical to SEQ ID NO: 245
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 642 - protein, 36 aa, Artificial Sequence; identical to SEQ ID NO: 246
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 643 - protein, 36 aa, Artificial Sequence; identical to SEQ ID NO: 247
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 644 - protein, 36 aa, Artificial Sequence; identical to SEQ ID NO: 248
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 645 - protein, 36 aa, Artificial Sequence; identical to SEQ ID NO: 249
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 646 - protein, 36 aa, Artificial Sequence; identical to SEQ ID NO: 250
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 647 - protein, 36 aa, Artificial Sequence; identical to SEQ ID NO: 251
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 648 - protein, 36 aa, Artificial Sequence; identical to SEQ ID NO: 252
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 649 - protein, 36 aa, Artificial Sequence; identical to SEQ ID NO: 253
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 650 - protein, 36 aa, Artificial Sequence; identical to SEQ ID NO: 254
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 651 - protein, 36 aa, Artificial Sequence; identical to SEQ ID NO: 255
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 652 - protein, 36 aa, Artificial Sequence; identical to SEQ ID NO: 256
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 653 - protein, 36 aa, Artificial Sequence; identical to SEQ ID NO: 257
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 654 - protein, 36 aa, Artificial Sequence; identical to SEQ ID NO: 258
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 655 - protein, 36 aa, Artificial Sequence; identical to SEQ ID NO: 259
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 656 - protein, 36 aa, Artificial Sequence; identical to SEQ ID NO: 260
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 657 - protein, 36 aa, Artificial Sequence; identical to SEQ ID NO: 261
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 658 - protein, 36 aa, Artificial Sequence; identical to SEQ ID NO: 262
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 659 - protein, 36 aa, Artificial Sequence; identical to SEQ ID NO: 263
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 660 - protein, 36 aa, Artificial Sequence; identical to SEQ ID NO: 264
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 661 - protein, 36 aa, Artificial Sequence; identical to SEQ ID NO: 265
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 662 - protein, 36 aa, Artificial Sequence; identical to SEQ ID NO: 266
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 663 - protein, 36 aa, Artificial Sequence; identical to SEQ ID NO: 267
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 664 - protein, 36 aa, Artificial Sequence; identical to SEQ ID NO: 268
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 665 - protein, 36 aa, Artificial Sequence; identical to SEQ ID NO: 269
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 666 - protein, 36 aa, Artificial Sequence; identical to SEQ ID NO: 270
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 667 - protein, 36 aa, Artificial Sequence; identical to SEQ ID NO: 271
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 668 - protein, 36 aa, Artificial Sequence; identical to SEQ ID NO: 272
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 669 - protein, 36 aa, Artificial Sequence; identical to SEQ ID NO: 273
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 670 - protein, 36 aa, Artificial Sequence; identical to SEQ ID NO: 274
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 671 - protein, 36 aa, Artificial Sequence; identical to SEQ ID NO: 275
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 672 - protein, 36 aa, Artificial Sequence; identical to SEQ ID NO: 276
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 673 - protein, 36 aa, Artificial Sequence; identical to SEQ ID NO: 277
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 674 - protein, 36 aa, Artificial Sequence; identical to SEQ ID NO: 278
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 675 - protein, 36 aa, Artificial Sequence; identical to SEQ ID NO: 279
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 676 - protein, 36 aa, Artificial Sequence; identical to SEQ ID NO: 280
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 677 - protein, 36 aa, Artificial Sequence; identical to SEQ ID NO: 281
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 678 - protein, 36 aa, Artificial Sequence; identical to SEQ ID NO: 282
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 679 - protein, 36 aa, Artificial Sequence; identical to SEQ ID NO: 283
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 680 - protein, 36 aa, Artificial Sequence; identical to SEQ ID NO: 284
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 681 - protein, 36 aa, Artificial Sequence; identical to SEQ ID NO: 285
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 682 - protein, 36 aa, Artificial Sequence; identical to SEQ ID NO: 286
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 683 - protein, 36 aa, Artificial Sequence; identical to SEQ ID NO: 287
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 684 - protein, 36 aa, Artificial Sequence; identical to SEQ ID NO: 288
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 685 - protein, 36 aa, Artificial Sequence; identical to SEQ ID NO: 289
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 686 - protein, 36 aa, Artificial Sequence; identical to SEQ ID NO: 290
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 687 - protein, 36 aa, Artificial Sequence; identical to SEQ ID NO: 291
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 688 - protein, 36 aa, Artificial Sequence; identical to SEQ ID NO: 292
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 689 - protein, 36 aa, Artificial Sequence; identical to SEQ ID NO: 293
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 690 - protein, 36 aa, Artificial Sequence; identical to SEQ ID NO: 294
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 691 - protein, 36 aa, Artificial Sequence; identical to SEQ ID NO: 295
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 692 - protein, 36 aa, Artificial Sequence; identical to SEQ ID NO: 296
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 693 - protein, 36 aa, Artificial Sequence; identical to SEQ ID NO: 297
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 694 - protein, 36 aa, Artificial Sequence; identical to SEQ ID NO: 298
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 695 - protein, 36 aa, Artificial Sequence; identical to SEQ ID NO: 299
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 696 - protein, 36 aa, Artificial Sequence; identical to SEQ ID NO: 300
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 697 - protein, 36 aa, Artificial Sequence; identical to SEQ ID NO: 301
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 698 - protein, 36 aa, Artificial Sequence; identical to SEQ ID NO: 302
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 699 - protein, 36 aa, Artificial Sequence; identical to SEQ ID NO: 303
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 700 - protein, 36 aa, Artificial Sequence; identical to SEQ ID NO: 304
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 701 - protein, 36 aa, Artificial Sequence; identical to SEQ ID NO: 305
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 702 - protein, 33 aa, Artificial Sequence; identical to SEQ ID NO: 144
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 703 - protein, 33 aa, Artificial Sequence; identical to SEQ ID NO: 145
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 704 - protein, 33 aa, Artificial Sequence; identical to SEQ ID NO: 146
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 705 - protein, 33 aa, Artificial Sequence; identical to SEQ ID NO: 147
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 706 - protein, 33 aa, Artificial Sequence; identical to SEQ ID NO: 148
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 707 - protein, 33 aa, Artificial Sequence; identical to SEQ ID NO: 149
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 708 - protein, 33 aa, Artificial Sequence; identical to SEQ ID NO: 150
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 709 - protein, 33 aa, Artificial Sequence; identical to SEQ ID NO: 151
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 710 - protein, 33 aa, Artificial Sequence; identical to SEQ ID NO: 152
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 711 - protein, 33 aa, Artificial Sequence; identical to SEQ ID NO: 153
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 712 - protein, 33 aa, Artificial Sequence; identical to SEQ ID NO: 154
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 713 - protein, 33 aa, Artificial Sequence; identical to SEQ ID NO: 155
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 714 - protein, 33 aa, Artificial Sequence; identical to SEQ ID NO: 156
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 715 - protein, 33 aa, Artificial Sequence; identical to SEQ ID NO: 157
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 716 - protein, 33 aa, Artificial Sequence; identical to SEQ ID NO: 158
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 717 - protein, 33 aa, Artificial Sequence; identical to SEQ ID NO: 159
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 718 - protein, 33 aa, Artificial Sequence; identical to SEQ ID NO: 160
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 719 - protein, 33 aa, Artificial Sequence; identical to SEQ ID NO: 620
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 720 - protein, 33 aa, Artificial Sequence; identical to SEQ ID NO: 162
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 721 - protein, 33 aa, Artificial Sequence; identical to SEQ ID NO: 163
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 722 - protein, 33 aa, Artificial Sequence; identical to SEQ ID NO: 164
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 723 - protein, 33 aa, Artificial Sequence; identical to SEQ ID NO: 165
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 724 - protein, 33 aa, Artificial Sequence; identical to SEQ ID NO: 166
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 725 - protein, 33 aa, Artificial Sequence; identical to SEQ ID NO: 167
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 726 - protein, 33 aa, Artificial Sequence; identical to SEQ ID NO: 168
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 727 - protein, 33 aa, Artificial Sequence; identical to SEQ ID NO: 169
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 728 - protein, 33 aa, Artificial Sequence; identical to SEQ ID NO: 170
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 729 - protein, 33 aa, Artificial Sequence; identical to SEQ ID NO: 171
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 730 - protein, 33 aa, Artificial Sequence; identical to SEQ ID NO: 172
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 731 - protein, 33 aa, Artificial Sequence; identical to SEQ ID NO: 173
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 732 - protein, 33 aa, Artificial Sequence; identical to SEQ ID NO: 174
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 733 - protein, 33 aa, Artificial Sequence; identical to SEQ ID NO: 175
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 734 - protein, 33 aa, Artificial Sequence; identical to SEQ ID NO: 176
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 735 - protein, 33 aa, Artificial Sequence; identical to SEQ ID NO: 177
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 736 - protein, 33 aa, Artificial Sequence; identical to SEQ ID NO: 178
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 737 - protein, 33 aa, Artificial Sequence; identical to SEQ ID NO: 179
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 738 - protein, 36 aa, Artificial Sequence; identical to SEQ ID NO: 243
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 739 - protein, 36 aa, Artificial Sequence; identical to SEQ ID NO: 244
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 740 - protein, 36 aa, Artificial Sequence; identical to SEQ ID NO: 245
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 741 - protein, 36 aa, Artificial Sequence; identical to SEQ ID NO: 246
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 742 - protein, 36 aa, Artificial Sequence; identical to SEQ ID NO: 247
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 743 - protein, 36 aa, Artificial Sequence; identical to SEQ ID NO: 248
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 744 - protein, 36 aa, Artificial Sequence; identical to SEQ ID NO: 249
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 745 - protein, 36 aa, Artificial Sequence; identical to SEQ ID NO: 250
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 746 - protein, 36 aa, Artificial Sequence; identical to SEQ ID NO: 251
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 747 - protein, 36 aa, Artificial Sequence; identical to SEQ ID NO: 252
  Synthetic peptide
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 748 - protein, 36 aa, Artificial Sequence; identical to SEQ ID NO: 253
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 749 - protein, 36 aa, Artificial Sequence; identical to SEQ ID NO: 254
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 750 - protein, 36 aa, Artificial Sequence; identical to SEQ ID NO: 255
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 751 - protein, 36 aa, Artificial Sequence; identical to SEQ ID NO: 256
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 752 - protein, 36 aa, Artificial Sequence; identical to SEQ ID NO: 257
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 753 - protein, 36 aa, Artificial Sequence; identical to SEQ ID NO: 258
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 754 - protein, 36 aa, Artificial Sequence; identical to SEQ ID NO: 259
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 755 - protein, 36 aa, Artificial Sequence; identical to SEQ ID NO: 260
  Synthetic peptide
  MOD_RES (8)..(9): Any L- or D-natural amino acid and any non-natural amino acid; see specification as filed for detailed description of substitutions and preferred embodiments
  MOD_RES (11)..(12): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 756 - protein, 36 aa, Artificial Sequence; identical to SEQ ID NO: 261
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 757 - protein, 36 aa, Artificial Sequence; identical to SEQ ID NO: 262
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 758 - protein, 36 aa, Artificial Sequence; identical to SEQ ID NO: 263
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 759 - protein, 36 aa, Artificial Sequence; identical to SEQ ID NO: 264
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 760 - protein, 36 aa, Artificial Sequence; identical to SEQ ID NO: 265
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 761 - protein, 36 aa, Artificial Sequence; identical to SEQ ID NO: 266
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 762 - protein, 36 aa, Artificial Sequence; identical to SEQ ID NO: 267
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 763 - protein, 36 aa, Artificial Sequence; identical to SEQ ID NO: 268
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 764 - protein, 36 aa, Artificial Sequence; identical to SEQ ID NO: 269
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (13)..(13): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 765 - protein, 36 aa, Artificial Sequence; identical to SEQ ID NO: 270
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 766 - protein, 36 aa, Artificial Sequence; identical to SEQ ID NO: 271
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 767 - protein, 36 aa, Artificial Sequence; identical to SEQ ID NO: 272
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 768 - protein, 36 aa, Artificial Sequence; identical to SEQ ID NO: 273
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 769 - protein, 36 aa, Artificial Sequence; identical to SEQ ID NO: 274
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 770 - protein, 36 aa, Artificial Sequence; identical to SEQ ID NO: 275
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 771 - protein, 36 aa, Artificial Sequence; identical to SEQ ID NO: 276
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 772 - protein, 36 aa, Artificial Sequence; identical to SEQ ID NO: 277
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 773 - protein, 36 aa, Artificial Sequence; identical to SEQ ID NO: 278
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (14)..(14): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 774 - protein, 36 aa, Artificial Sequence; identical to SEQ ID NO: 279
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 775 - protein, 36 aa, Artificial Sequence; identical to SEQ ID NO: 280
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 776 - protein, 36 aa, Artificial Sequence; identical to SEQ ID NO: 281
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 777 - protein, 36 aa, Artificial Sequence; identical to SEQ ID NO: 282
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 778 - protein, 36 aa, Artificial Sequence; identical to SEQ ID NO: 283
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 779 - protein, 36 aa, Artificial Sequence; identical to SEQ ID NO: 284
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 780 - protein, 36 aa, Artificial Sequence; identical to SEQ ID NO: 285
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 781 - protein, 36 aa, Artificial Sequence; identical to SEQ ID NO: 286
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 782 - protein, 36 aa, Artificial Sequence; identical to SEQ ID NO: 287
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (15)..(15): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 783 - protein, 36 aa, Artificial Sequence; identical to SEQ ID NO: 288
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 784 - protein, 36 aa, Artificial Sequence; identical to SEQ ID NO: 289
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 785 - protein, 36 aa, Artificial Sequence; identical to SEQ ID NO: 290
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 786 - protein, 36 aa, Artificial Sequence; identical to SEQ ID NO: 291
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 787 - protein, 36 aa, Artificial Sequence; identical to SEQ ID NO: 292
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 788 - protein, 36 aa, Artificial Sequence; identical to SEQ ID NO: 293
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 789 - protein, 36 aa, Artificial Sequence; identical to SEQ ID NO: 294
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 790 - protein, 36 aa, Artificial Sequence; identical to SEQ ID NO: 295
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 791 - protein, 36 aa, Artificial Sequence; identical to SEQ ID NO: 296
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (16)..(16): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 792 - protein, 36 aa, Artificial Sequence; identical to SEQ ID NO: 297
  Synthetic peptide
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 793 - protein, 36 aa, Artificial Sequence; identical to SEQ ID NO: 298
  Synthetic peptide
  MOD_RES (1)..(1): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 794 - protein, 36 aa, Artificial Sequence; identical to SEQ ID NO: 299
  Synthetic peptide
  MOD_RES (2)..(2): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 795 - protein, 36 aa, Artificial Sequence; identical to SEQ ID NO: 300
  Synthetic peptide
  MOD_RES (3)..(3): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 796 - protein, 36 aa, Artificial Sequence; identical to SEQ ID NO: 301
  Synthetic peptide
  MOD_RES (4)..(4): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 797 - protein, 36 aa, Artificial Sequence; identical to SEQ ID NO: 302
  Synthetic peptide
  MOD_RES (5)..(5): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 798 - protein, 36 aa, Artificial Sequence; identical to SEQ ID NO: 303
  Synthetic peptide
  MOD_RES (6)..(6): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 799 - protein, 36 aa, Artificial Sequence; identical to SEQ ID NO: 304
  Synthetic peptide
  MOD_RES (7)..(7): Any L- or D-natural amino acid and any non-natural amino acid; see specification as filed for detailed description of substitutions and preferred embodiments
  MOD_RES (9)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 800 - protein, 36 aa, Artificial Sequence; identical to SEQ ID NO: 305
  Synthetic peptide
  MOD_RES (8)..(9): Any L- or D-natural amino acid and any non-natural amino acid; see specification as filed for detailed description of substitutions and preferred embodiments
  MOD_RES (11)..(11): Any L- or D-natural amino acid and any non-natural amino acid; see specification as filed for detailed description of substitutions and preferred embodiments
  MOD_RES (17)..(17): Any L- or D-natural amino acid and any non-natural amino acid; see specification as filed for detailed description of substitutions and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 801 - protein, 31 aa, Artificial Sequence; identical to SEQ ID NO: 5
  Synthetic peptide

SEQ ID NO: 802 - protein, 9 aa, Artificial Sequence
  Synthetic peptide
KPVSLSYRC

SEQ ID NO: 803 - protein, 31 aa, Artificial Sequence; identical to SEQ ID NO: 5
  Synthetic peptide

SEQ ID NO: 804 - protein, 17 aa, Artificial Sequence
  Synthetic peptide
KPVSLSYRCPCRFFESH

SEQ ID NO: 805 - protein, 8 aa, Artificial Sequence
  Synthetic peptide
KPVSLSYR

SEQ ID NO: 806 - protein, 31 aa, Artificial Sequence; identical to SEQ ID NO: 5
  Synthetic peptide

SEQ ID NO: 807 - protein, 31 aa, Artificial Sequence
  Synthetic peptide
  MOD_RES (2)..(2): Any L- or D-natural amino acid and any non-natural amino acid; see specification as filed for detailed description of substitutions and preferred embodiments
  MOD_RES (5)..(5): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXVSXSYRCPCRFFXXXXLKWIQEYLEKALN

SEQ ID NO: 808 - protein, 31 aa, Artificial Sequence; identical to SEQ ID NO: 807
  Synthetic peptide
  MOD_RES (2)..(2): Any L- or D-natural amino acid and any non-natural amino acid; see specification as filed for detailed description of substitutions and preferred embodiments
  MOD_RES (5)..(5): Any L- or D-natural amino acid and any non-natural amino acid; see specification as filed for detailed description of substitutions and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 809 - protein, 31 aa, Artificial Sequence; identical to SEQ ID NO: 5
  Synthetic peptide

SEQ ID NO: 810 - protein, 31 aa, Artificial Sequence
  Synthetic peptide
  c-term may be amidated
KPVSLSYRAPFRFFGGGGLKWIQEYLEKALN

SEQ ID NO: 811 - protein, 31 aa, Artificial Sequence; identical to SEQ ID NO: 5
  Synthetic peptide
  c-term may be amidated

SEQ ID NO: 812 - protein, 28 aa, Artificial Sequence
  Synthetic peptide
  MOD_RES (15)..(15): 11aminoundecanoic acid
  c-term may be amidated
KPVSLSYRCPCRFFXLKWIQEYLEKALN

SEQ ID NO: 813 - protein, 31 aa, Artificial Sequence; identical to SEQ ID NO: 5
  Synthetic peptide
  MOD_RES (1)..(1): desLys
  c-term may be amidated

SEQ ID NO: 814 - protein, 31 aa, Artificial Sequence; identical to SEQ ID NO: 5
  Synthetic peptide
  MOD_RES (2)..(2): D-Pro
  c-term may be amidated

SEQ ID NO: 815 - protein, 31 aa, Artificial Sequence; identical to SEQ ID NO: 5
  Synthetic peptide
  MOD_RES (5)..(5): D-Leu
  c-term may be amidated

SEQ ID NO: 816 - protein, 28 aa, Artificial Sequence
  Synthetic peptide
  MOD_RES (15)..(15): 11aminoundecanoic acid
  c-term may be amidated
KPVSLSYRCPCRFFXLKWIQEYLEKALN

SEQ ID NO: 817 - protein, 31 aa, Artificial Sequence; identical to SEQ ID NO: 810
  Synthetic peptide
  c-term may be amidated

SEQ ID NO: 818 - protein, 14 aa, Artificial Sequence
  Synthetic peptide
KPVSLSYRAPFRFF

SEQ ID NO: 819 - protein, 31 aa, Artificial Sequence; identical to SEQ ID NO: 5
  Synthetic peptide
  MOD_RES (2)..(2): D-Pro
  MOD_RES (5)..(5): D-Leu
  c-term may be amidated

SEQ ID NO: 820 - protein, 14 aa, Artificial Sequence
  Synthetic peptide
  MOD_RES (2)..(2): D-Pro
  MOD_RES (5)..(5): D-Leu
KPVSLSYRCPCRFF

SEQ ID NO: 821 - protein, 31 aa, Artificial Sequence
  Synthetic peptide
  c-term may be amidated
KPVSLSYRAPHRFFGGGGLKWIQEYLEKALN

SEQ ID NO: 822 - protein, 14 aa, Artificial Sequence
  Synthetic peptide
KPVSLSYRAPHRFF

SEQ ID NO: 823 - protein, 30 aa, Artificial Sequence
  Synthetic peptide
  c-term may be amidated
KPVSLSYRAPHRFFGGGGLKWIQEYEKALN

SEQ ID NO: 824 - protein, 31 aa, Artificial Sequence; identical to SEQ ID NO: 821
  Synthetic peptide
  MOD_RES (2)..(2): D-Pro
  MOD_RES (5)..(5): D-Leu
  c-term may be amidated

SEQ ID NO: 825 - protein, 14 aa, Artificial Sequence
  Synthetic peptide
  MOD_RES (2)..(2): D-Pro
  MOD_RES (5)..(5): D-Leu
KPVSLSYRAPHRFF

SEQ ID NO: 826 - protein, 31 aa, Artificial Sequence
  Synthetic peptide
  c-term may be amidated
KPVSLSYRAPWRFFGGGGLKWIQEYLEKALN

SEQ ID NO: 827 - protein, 14 aa, Artificial Sequence
  Synthetic peptide
KPVSLSYRAPWRFF

SEQ ID NO: 828 - protein, 31 aa, Artificial Sequence; identical to SEQ ID NO: 826
  Synthetic peptide
  MOD_RES (2)..(2): D-Pro
  MOD_RES (5)..(5): D-Leu
  c-term may be amidated

SEQ ID NO: 829 - protein, 14 aa, Artificial Sequence
  Synthetic peptide
  MOD_RES (2)..(2): D-Pro
  MOD_RES (5)..(5): D-Leu
KPVSLSYRAPWRFF

SEQ ID NO: 830 - protein, 31 aa, Artificial Sequence
  Synthetic peptide
  c-term may be amidated
KPVSLSYRFPARFFGGGGLKWIQEYLEKALN

SEQ ID NO: 831 - protein, 14 aa, Artificial Sequence
  Synthetic peptide
KPVSLSYRFPARFF

SEQ ID NO: 832 - protein, 31 aa, Artificial Sequence; identical to SEQ ID NO: 830
  Synthetic peptide
  MOD_RES (2)..(2): D-Pro
  MOD_RES (5)..(5): D-Leu
  c-term may be amidated

SEQ ID NO: 833 - protein, 14 aa, Artificial Sequence
  Synthetic peptide
  MOD_RES (2)..(2): D-Pro
  MOD_RES (5)..(5): D-Leu
KPVSLSYRFPARFF

SEQ ID NO: 834 - protein, 31 aa, Artificial Sequence
  Synthetic peptide
  c-term may be amidated
KPVSLSYRHPARFFGGGGLKWIQEYLEKALN

SEQ ID NO: 835 - protein, 14 aa, Artificial Sequence
  Synthetic peptide
KPVSLSYRHPARFF

SEQ ID NO: 836 - protein, 31 aa, Artificial Sequence; identical to SEQ ID NO: 834
  Synthetic peptide
  MOD_RES (2)..(2): D-Pro
  MOD_RES (5)..(5): D-Leu
  c-term may be amidated

SEQ ID NO: 837 - protein, 14 aa, Artificial Sequence
  Synthetic peptide
  MOD_RES (2)..(2): D-Pro
  MOD_RES (5)..(5): D-Leu
KPVSLSYRHPARFF

SEQ ID NO: 838 - protein, 31 aa, Artificial Sequence
  Synthetic peptide
  c-term may be amidated
KPVSLSYRWPARFFGGGGLKWIQEYLEKALN

SEQ ID NO: 839 - protein, 14 aa, Artificial Sequence
  Synthetic peptide
KPVSLSYRWPARFF

SEQ ID NO: 840 - protein, 31 aa, Artificial Sequence; identical to SEQ ID NO: 838
  Synthetic peptide
  MOD_RES (2)..(2): D-Pro
  MOD_RES (5)..(5): D-Leu
  c-term may be amidated

SEQ ID NO: 841 - protein, 14 aa, Artificial Sequence
  Synthetic peptide
  MOD_RES (2)..(2): D-Pro
  MOD_RES (5)..(5): D-Leu
KPVSLSYRWPARFF

SEQ ID NO: 842 - protein, 31 aa, Artificial Sequence
  Synthetic peptide
  c-term may be amidated
KPVSLSYRAPYRFFGGGGLKWIQEYLEKALN

SEQ ID NO: 843 - protein, 14 aa, Artificial Sequence
  Synthetic peptide
KPVSLSYRAPYRFF

SEQ ID NO: 844 - protein, 31 aa, Artificial Sequence; identical to SEQ ID NO: 842
  Synthetic peptide
  MOD_RES (2)..(2): D-Pro
  MOD_RES (5)..(5): D-Leu
  c-term may be amidated

SEQ ID NO: 845 - protein, 14 aa, Artificial Sequence
  Synthetic peptide
  MOD_RES (2)..(2): D-Pro
  MOD_RES (5)..(5): D-Leu
KPVSLSYRAPYRFF

SEQ ID NO: 846 - protein, 31 aa, Artificial Sequence
  Synthetic peptide
  c-term may be amidated
KPVSLSYRYPYRFFGGGGLKWIQEYLEKALN

SEQ ID NO: 847 - protein, 14 aa, Artificial Sequence
  Synthetic peptide
KPVSLSYRYPYRFF

SEQ ID NO: 848 - protein, 31 aa, Artificial Sequence; identical to SEQ ID NO: 846
  Synthetic peptide
  MOD_RES (2)..(2): D-Pro
  MOD_RES (5)..(5): D-Leu
  c-term may be amidated

SEQ ID NO: 849 - protein, 14 aa, Artificial Sequence
  Synthetic peptide
  MOD_RES (2)..(2): D-Pro
  MOD_RES (5)..(5): D-Leu
KPVSLSYRYPYRFF

SEQ ID NO: 850 - protein, 31 aa, Artificial Sequence
  Synthetic peptide
  c-term may be amidated
KPVSLSYRYPARFFGGGGLKWIQEYLEKALN

SEQ ID NO: 851 - protein, 14 aa, Artificial Sequence
  Synthetic peptide
KPVSLSYRYPARFF

SEQ ID NO: 852 - protein, 31 aa, Artificial Sequence; identical to SEQ ID NO: 850
  Synthetic peptide
  MOD_RES (2)..(2): D-Pro
  MOD_RES (5)..(5): D-Leu
  c-term may be amidated

SEQ ID NO: 853 - protein, 14 aa, Artificial Sequence
  Synthetic peptide
  MOD_RES (2)..(2): D-Pro
  MOD_RES (5)..(5): D-Leu
KPVSLSYRYPARFF

SEQ ID NO: 854 - protein, 31 aa, Artificial Sequence
  Synthetic peptide
  c-term may be amidated
KPVSLSYRFPFRFFGGGGLKWIQEYLEKALN

SEQ ID NO: 855 - protein, 14 aa, Artificial Sequence
  Synthetic peptide
KPVSLSYRFPFRFF

SEQ ID NO: 856 - protein, 31 aa, Artificial Sequence; identical to SEQ ID NO: 854
  Synthetic peptide
  MOD_RES (2)..(2): D-Pro
  MOD_RES (5)..(5): D-Leu
  c-term may be amidated

SEQ ID NO: 857 - protein, 14 aa, Artificial Sequence
  Synthetic peptide
  MOD_RES (2)..(2): D-Pro
  MOD_RES (5)..(5): D-Leu
KPVSLSYRFPFRFF

SEQ ID NO: 858 - protein, 31 aa, Artificial Sequence
  Synthetic peptide
  c-term may be amidated
KPVSLSYRHPHRFFGGGGLKWIQEYLEKALN

SEQ ID NO: 859 - protein, 14 aa, Artificial Sequence
  Synthetic peptide
KPVSLSYRHPHRFF

SEQ ID NO: 860 - protein, 31 aa, Artificial Sequence; identical to SEQ ID NO: 858
  Synthetic peptide
  MOD_RES (2)..(2): D-Pro
  MOD_RES (5)..(5): D-Leu
  c-term may be amidated

SEQ ID NO: 861 - protein, 14 aa, Artificial Sequence
  Synthetic peptide
  MOD_RES (2)..(2): D-Pro
  MOD_RES (5)..(5): D-Leu
KPVSLSYRHPHRFF

SEQ ID NO: 862 - protein, 31 aa, Artificial Sequence
  Synthetic peptide
  c-term may be amidated
KPVSLSYRWPWRFFGGGGLKWIQEYLEKALN

SEQ ID NO: 863 - protein, 14 aa, Artificial Sequence
  Synthetic peptide
KPVSLSYRWPWRFF

SEQ ID NO: 864 - protein, 31 aa, Artificial Sequence; identical to SEQ ID NO: 862
  Synthetic peptide
  MOD_RES (2)..(2): D-Pro
  MOD_RES (5)..(5): D-Leu
  c-term may be amidated

SEQ ID NO: 865 - protein, 14 aa, Artificial Sequence
  Synthetic peptide
  MOD_RES (2)..(2): D-Pro
  MOD_RES (5)..(5): D-Leu
KPVSLSYRWPWRFF

SEQ ID NO: 866 - protein, 14 aa, Artificial Sequence
  Synthetic peptide
KPVSLSYRCPCRFF

SEQ ID NO: 867 - protein, 13 aa, Artificial Sequence
  Synthetic peptide
  c-term may be amidated
LKWIQEYLEKALN

SEQ ID NO: 868 - protein, 4 aa, Artificial Sequence
  Synthetic peptide
GGGG

We claim:

1. A method of increasing the number of hematopoietic cells circulating in the blood of a subject comprising administering an effective amount of a composition comprising an SDF-1 mimetic to the subject, wherein the SDF-1 mimetic consists of the following structure:

$R_N$—HN-Xaa$_3$-Pro-Val-Ser-Leu-Ser-Tyr-Arg-Xaa$_1$-Pro-Xaa$_2$-Arg-Phe-Phe-[linker]-Leu-Lys-Trp-Ile-Gln-Glu-Tyr-Leu-Glu-Lys-Ala-Leu-Asn-Rc (SEQ ID NO:10);

wherein, $R_N$ is an N-terminal modifier that comprises a component selected from a group consisting of hydrogen, poly(ethylene glycol), a biochemical label, a radiolabel, an acyl group, an acetyl group, and an N-terminal modifier capable of reducing the ability of the SDF-1 mimetic to act as a substrate for aminopeptidases;

$R_C$ is a C-terminal modifier that comprises a component selected from a group consisting of a hydroxyl group, poly(ethylene glycol), a biochemical label, a radiolabel, an amido group, and a C-terminal modifier capable of reducing the ability of the SDF-1 mimetic to act as a substrate for carboxypeptidases;

Xaa$_1$ is Ala and Xaa$_2$ is Phe;

Xaa$_3$ is Lys or des-Lys;

and, the linker is Gly-Gly-Gly-Gly (residues 15-18 of SEQ ID NO:810) or —(CH$_2$)$_n$—, wherein n is an integer ranging from 9 to 14.

2. The method of claim 1, wherein the SDF-1 mimetic is SEQ ID NO:810, cyclized at Lys$^{20}$ and Glu$^{24}$.

3. The method of claim 1, wherein the linker is 11-aminoundecanoic acid and the C-terminal portion is cyclized at Lys$^{20}$ and Glu$^{24}$.

4. The method of claim 1, wherein the C-terminal portion is cyclized at Lys$^{20}$ and Glu$^{24}$.

5. The method of claim 1, wherein the C-terminal portion is cyclized at Glu$^{24}$ and Lys$^{28}$.

6. The method of claim 1, wherein the C-terminal portion is cyclized at Glu$^{24}$ and Lys$^{28}$, and the linker is 11-aminoundecanoic acid.

7. The method of claim 1, wherein the linker is 11-aminoundecanoic acid.

8. The method of claim 1, wherein the administering results in mobilizing the hematopoietic cells.

9. The method of claim 1, wherein the administering results in enhancing recovery of the hematopoietic cells following chemotherapy.

10. The method of claim 9, wherein the enhancing comprises reducing the rate of multiplication of the hematopoietic cells to inhibit the effect of a cytotoxic agent on the hematopoietic cells during the chemotherapy.

11. The method of claim 1, wherein the administering results in enhancing an engraftment of the hematopoietic cells in a second subject.

12. The method of claim 1 further comprising administering a second agent, wherein the administering of the second agent is sequential or concurrent to the administering of the composition comprising the SDF-1 mimetic.

13. The method of claim 12, wherein the second agent comprises G-CSF.

14. The method of claim 1, wherein the hematopoietic cell is selected from a group consisting of hematopoietic stem cells, hematopoietic progenitor cells, primitive granulocytes, primitive erythroid cells, leukocytes, or neutrophils.

15. The method of claim 1, wherein the hematopoietic cell is a hematopoietic stem cell or a hematopoietic progenitor cell.

16. The method of claim 1, wherein the SDF-1 mimetic comprises a C-terminal acid.

17. The method of claim 1, wherein the SDF-1 mimetic comprises a C-terminal amide.

18. The method of claim 1, wherein the SDF-1 mimetic consists of:

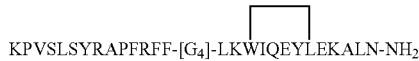
KPVSLSYRAPFRFF-[G₄]-LKWIQEYLEKALN-NH₂

(SEQ ID NO. 405, wherein $R_N$=H, $R_C$=NH₂, Xaa1=Ala, Xaa2=Phe, Xaa3=Lys, and the C-terminal is cyclized at K20/E24).

19. The method of claim 1, wherein the SDF-1 mimetic consists of:

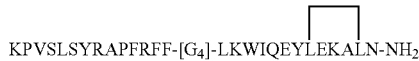
KPVSLSYRAPFRFF-[G₄]-LKWIQEYLEKALN-NH₂

(SEQ ID NO. 306, wherein $R_N$=H, $R_C$=NH₂, Xaa1=Ala, Xaa2=Phe, Xaa3=Lys, and the C-terminal is cyclized at K25/E28).

20. The method of claim 1, wherein the peptide comprises a sequence selected from the group consisting of:
a first amino acid sequence:

KPVSLSYRAPFRFF-[LINKER]-LKWIQEYLEKALN-NH₂(OH)

(residue positions 1-14 of SEQ ID NO.:1 linked to residue positions 19-31 of SEQ ID NO:1, acid or amide, wherein residue Cys⁹ is substituted by [Ala⁹] and residue Cys¹¹ is substituted by [Phe¹¹]);
wherein, the LINKER comprises 4 natural amino acids; or, an amino acid having the structure H₂N—$Z_A$—COOH, where $Z_A$ is selected from a group consisting of an alkylene consisting of 20 or fewer carbon atoms;
a second amino acid sequence conserving the residue P², A⁹, F¹¹ and the L⁵S⁶Y⁷ motif and otherwise having at least 95% identity to residues 1-14 and 19-31 of the first amino acid sequence and having the function of binding to a CXCR4 receptor; and
a third amino acid sequence conserving the residue P², A⁹, F¹¹ and the L⁵S⁶Y⁷ motif, otherwise having a conservative substitution in residues 1-14 and 19-31 of the first amino acid sequence, and having the function of binding to a CXCR4 receptor.

21. The method of claim 1, wherein the peptide comprises a sequence selected from the group consisting of:
a first amino acid sequence:

KPVSLSYRAPFRFF-[LINKER]-LKWIQEYLEKALN-NH₂(OH)

(residue positions 1-14 of SEQ ID NO.:1 linked to residue positions 19-31 of SEQ ID NO:1, acid or amide, wherein residue Cys⁹ is substituted by [Ala⁹] and residue Cys¹¹ is substituted by [Phe¹¹]);
wherein, the LINKER comprises 4 natural amino acids; or, an amino acid having the structure H₂N—$Z_A$—COOH, where $Z_A$ is selected from a group consisting of an alkylene consisting of 20 or fewer carbon atoms;
a second amino acid sequence conserving the residue P², A⁹, F¹¹ and the L⁵S⁶Y⁷ motif and otherwise having at least 95% identity to residues 1-14 and 19-31 of the first amino acid sequence and having the function of binding to a CXCR4 receptor; and
a third amino acid sequence conserving the residue P², A⁹, F¹¹ and the L⁵S⁶Y⁷ motif, otherwise having a conservative substitution in residues 1-14 and 19-31 of the first amino acid sequence, and having the function of binding to a CXCR4 receptor.

22. The CXCR4 peptide of claim 20 or 21, wherein the linker consists of Gly-Gly-Gly-Gly (residues 15-18 of SEQ ID NO:810).

* * * * *